US009833497B2

(12) United States Patent
Song et al.

(10) Patent No.: US 9,833,497 B2
(45) Date of Patent: Dec. 5, 2017

(54) HUMAN ORIGINATED EGF DOMAIN PROTEINS AND USE OF THE SAME

(71) Applicant: CHENGDU SOURCEBIO LIMITED-LIABILITY COMPANY, Chengdu (CN)

(72) Inventors: Xu Song, Sichuan (CN); Ling Li, Sichuan (CN); Jinwu Chen, Sichuan (CN); Deng Jiao Ma, Sichuan (CN)

(73) Assignee: Chengdu Sourcebio Limited-Liability Company, Chengdu (CN)

( * ) Notice: Subject to any disclaimer, the term of this patent is extended or adjusted under 35 U.S.C. 154(b) by 0 days.

(21) Appl. No.: 14/894,417

(22) PCT Filed: May 19, 2014

(86) PCT No.: PCT/CN2014/077789
§ 371 (c)(1),
(2) Date: Nov. 27, 2015

(87) PCT Pub. No.: WO2014/190860
PCT Pub. Date: Dec. 4, 2014

(65) Prior Publication Data
US 2016/0184396 A1 Jun. 30, 2016

(30) Foreign Application Priority Data

May 29, 2013 (CN) .......................... 2013 1 0206726
Apr. 30, 2014 (CN) .......................... 2014 1 0182727

(51) Int. Cl.
| | |
|---|---|
| A61K 38/36 | (2006.01) |
| C07K 14/00 | (2006.01) |
| A61K 38/18 | (2006.01) |
| C07K 14/485 | (2006.01) |

(52) U.S. Cl.
CPC .......... *A61K 38/1808* (2013.01); *A61K 38/36* (2013.01); *C07K 14/485* (2013.01)

(58) Field of Classification Search
CPC ... A61K 38/1808; A61K 38/36; C07K 14/485
USPC .......... 514/2.8, 9.6; 435/252.1, 252.8, 253.3
See application file for complete search history.

(56) References Cited

U.S. PATENT DOCUMENTS

| | | | | |
|---|---|---|---|---|
| 2006/0234935 | A1* | 10/2006 | Blajchman | ....... C12Y 304/2102 514/14.3 |
| 2013/0202596 | A1* | 8/2013 | Salas | .................... C07K 14/745 424/134.1 |

FOREIGN PATENT DOCUMENTS

WO 2004108763 A2 12/2004

OTHER PUBLICATIONS

Gram Negative Bacteria from Merck Manual, pp. 1-4. Accessed Dec. 8, 2016.*
Introduction to Gram-negative Bacilli from Merck Manual, p. 1. Accessed Dec. 8, 2016.*
*Escherichia coli* Infections from Merck Manual, pp. 1-3. Accessed Dec. 8, 2016.*
Gram-negative Bacteria from www.niaid.nih.gov/research/gram-negative-bacteria. pp. 1-2. Accessed Dec. 8, 2016.*
Zhang et al., "Capability of the First Epidermal Growth Factor Domain of Rat Coagulation Factor VII in Vitro", Chinese Journal of Thrombosis and Hemostasis, 2007, vol. 12, No. 4, pp. 148-151.
Mei et al., "Binding of EGF1 Domain Peptide in Coagulation Factor VII with Tissue Factor and Its Implications for the Triggering of Coagulation", J Huazhong Univ Sci Technol 30(1), 2010, pp. 42-47.

\* cited by examiner

*Primary Examiner* — Julie Ha
(74) *Attorney, Agent, or Firm* — Calfee, Halter & Griswold LLP

(57) ABSTRACT

In the invention, the minimum inhibitory concentrations of human-originated EGF domain proteins against different Gram-negative bacteria are detected with the in vitro antibacterial activity. It has been shown that the human-originated EGF domain proteins have an obvious inhibitory effect on the Gram-negative bacteria, so as to develop a novel class of medicaments for treating Gram-negative bacteria infection. It has been demonstrated by silver staining that the human-originated EGF domain proteins have the effect on hydrolyzing and eliminating the endotoxin, which facilitates the development of a novel class of medicaments for treating endotoxemia. The amino acid sequences of the human-originated EGF domain proteins are the one described in SEQ ID NO: 1 in the sequence listing, or those having homology of over 50% to the amino acid sequence described in SEQ ID NO: 1.

18 Claims, 10 Drawing Sheets

HUMAN ORIGINATED EGF DOMAIN PROTEINS AND USE OF THE SAME

CROSS REFERENCE TO RELATED APPLICATIONS

This application is the U.S. national phase entry of PCT/CN2014/077789, with an international filing date of May 19, 2014, which claims priority to and any benefit of Chinese Patent Application No. 201310206726.6 filed May 29, 2013, and Chinese Patent Application No. 201410182727.6 filed Apr. 30, 2014, the entire contents of which are incorporated by reference in their entirety.

TECHNICAL FIELD

The present invention belongs to biomedical field, and especially relates to human-originated EGF domain proteins and use thereof in the pharmaceutical industry.

BACKGROUND

Gram-negative bacteria refer broadly to the bacteria which are stained in red in Gram's staining reaction, and they are different from the Gram-positive bacteria during the Gram's staining due to the difference in the structure of the cell wall (the positive bacteria being stained in violet). The Gram-negative bacteria are represented by *Escherichia coli*, as well as *Proteus, Shigella dysenteriae, Klebsiella pneumoniae, Brucella bacilli, Haemophilus influenzae, Haemophilus parainfluenzae, Moraxella catarrhalis, Acinetobacter* and so on. Pathogenicity of such bacteria is often associated with a particular component in their cell-walls, lipopolysaccharide (also known as endotoxin). In human's body, lipopolysaccharide will induce the body to produce a large amount of cytokines and to activate the immune system, eventually evoking innate immune responses against the pathogenic bacteria within the body. For instance, redness and swelling are the results of generation and release of a large amount of cytokines.

In addition to eliminating the focus of infection and a symptomatic and supportive treatment, antibiotics also need to be used during the treatment of a Gram-negative bacteria infection. At present, the antibiotics mainly used are aminoglycosides, beta-lactams, etc. These antibiotics have potent bactericidal effects on various Gram-negative bacteria, and moreover exhibit longer post-antibiotic effects on the common Gram-negative bacilli such as *Pseudomonas aeruginosa, Klebsiella pneumonia*, and *E. coli*. In addition to the antibiotics, the agents such as prostaglandin synthetase inhibitor, levamisole, and tuftsin are also useful in treatment of the Gram-negative bacteria infection. However, with the extensive application of antibiotics, the abuse of antibiotics in clinical medicine results in progression of the drug resistance of bacteria from single drug resistance into multi drug resistance, thus making many second-line antibiotics which would have been used effectively as alternatives ineffective. Secondly, the antibacterial drug may induce the generation of endotoxin while killing/inhibiting the bacteria, which increases the difficulty of treating the disease. Thus, while novel antibiotics with potent killing effect come out continuously and advanced supportive therapies occurs, treatment of the endotoxemia caused by Gram's negative bacteria infection is still a challenge in the clinical scenario, particularly with an unacceptable mortality rate of 20-30%. It has been reported that lipopolysaccharide is the major pathogenic factor which leads to a series of toxicity reaction occurring post the Gram-negative bacteria infection. Although antibiotics have a better effect of eliminating the bacteria, they have no effect on the lipopolysaccharide free in the blood and a wide variety of detrimental cytokines produced by target cells which are persistently stimulated with the free lipopolysaccharide. Therefore, when choosing an antibacterial drug clinically, a comprehensive consideration should be taken for the result of drug sensitive test and the feature of inducing release of the endotoxin. Thirdly, since lipopolysaccharide is located on the surface of the cell wall of Gram-negative bacteria, many early types of antibiotics are unable to inhibit such bacteria effectively. Based on these reasons, novel fields are being explored actively in treating Gram-negative bacteria infection in the recent years.

Antimicrobial peptides (AMPs) refer to short peptides having antibacterial activities, most of which have thermal stability, high alkalincity and broad-spectrum anti-bacterial activities. Currently, about more than or equal to 2000 of AMPs have already been identified from various organisms. These AMPs are synthesized after induction, play an important key role in an organism's resistance against the invasion of a pathogen, and are considered an important defensive constituent for the non-specific immunological function in an organism. Accordingly, it becomes a hot spot and a challenge to find out novel APMs against Gram-negative bacteria.

The EGF domain (the EGF-like domain, epidermal growth factor-like domain) is protein domains which is relatively conserved in evolution and has been designated due to first identification of the domain in epidermal growth factor. The EGF domain usually comprises 30-50 amino acid residues and has been currently identified in many animal proteins. E.g. human coagulation factor VII (human factor VII, hF VII). hF VII is a naturally-occurring protein in the human's body with molecular weight of about 50 kD. The molecule thereof comprises four domains: a membrane-bound N-terminal γ-carboxyglutamic acid domain (Gla domain), two EGF domains (EGF1 and EGF2), and a C-terminal serine protease domain. The human coagulation factor VII-EGF1 domain (hF VII-EGF1) has a molecular weight of about 3.9 kD. In human origin, there are also many analogues with the sequences similar to that of hF VII-EGF1, such as human-originated coagulation factor VII-EGF2 protein (hF VII-EGF2), human-originated coagulation factor IX-EGF1 protein (hF IX-EGF1), human-originated coagulation factor IX-EGF2 protein (hF IX-EGF2), human-originated coagulation factor X-EGF1 protein (hF X-EGF1), human-originated coagulation factor X-EGF2 protein (hF X-EGF2), etc. Up to now, there is no relevant report on treatment of a bacteria infection with a human-originated EGF domain protein as the antibacterial agent and no report on preparation of a medicament for treating endotoxemia caused by a Gram-negative bacterium.

SUMMARY OF THE INVENTION

One of the objectives of the present invention is to provide artificially-prepared human-originated EGF domain proteins. Another objective of the present invention is to prove that the human-originated EGF domain proteins have an inhibitory effect on the Gram-negative bacteria and that the human-originated EGF domain proteins can hydrolyze and thus eliminate endotoxin, so as to develop a novel class of medicaments for treating Gram-negative bacteria infection and medicaments for treating endotoxemia caused by the Gram-negative bacteria.

The human-originated EGF domain protein set forth in the present invention has the amino acid sequence described in SEQ ID NO: 1 in the sequence listing, or is the protein having homology of over 50% to the amino acid sequence described in SEQ ID NO: 1. The protein having homology of over 50% to the amino acid sequence of the protein described in SEQ ID NO: 1 has any of the amino acid sequences described in SEQ ID NO: 2 to SEQ ID NO: 1498 in the sequence listing.

The human-originated EGF domain proteins set forth in the present invention are designated as shown in Table 1.

TABLE 1

Designation of the human-originated EGF domain proteins set forth in the present invention

| No. in the sequence listing | Designation | Code in the invention |
|---|---|---|
| SEQ ID NO: 1 | human coagulation factor VII-EGF1 domain protein (hF VII-EGF1 protein) | PRT1 |
| SEQ ID NO: 2 | human coagulation factor VII-EGF2 domain protein (hF VII-EGF2 protein) | PRT2 |
| SEQ ID NO: 3 | human coagulation factor IX-EGF1 domain protein (hF IX-EGF1 protein) | PRT3 |
| SEQ ID NO: 4 | human coagulation factor IX-EGF2 domain protein (hF IX-EGF2 protein) | PRT4 |
| SEQ ID NO: 5 | human coagulation factor X-EGF1 domain protein (hF X-EGF1 protein) | PRT5 |
| SEQ ID NO: 6 | human coagulation factor X-EGF2 domain protein (hF X-EGF2 protein) | PRT6 |
| SEQ ID NO: 7 | human ADAM metallopeptidase domain 22-EGF1 protein | PRT7 |
| SEQ ID NO: 8 | human ADAM metallopeptidase domain 30-EGF1 protein | PRT8 |
| SEQ ID NO: 9 | human ADAM metallopeptidase domain 33, isoform CRA_g-EGF1 protein | PRT9 |
| SEQ ID NO: 10 | human ADAM8 protein-EGF1 protein | PRT10 |
| SEQ ID NO: 11 | human ADAM9 protein-EGF1 protein | PRT11 |
| SEQ ID NO: 12 | human ADAM9 protein-EGF2 protein | PRT12 |
| SEQ ID NO: 13 | human Aggrecan core protein-EGF1 protein | PRT13 |
| SEQ ID NO: 14 | human Agrin-EGF1 protein | PRT14 |
| SEQ ID NO: 15 | human Agrin-EGF2 protein | PRT15 |
| SEQ ID NO: 16 | human Agrin-EGF3 protein | PRT16 |
| SEQ ID NO: 17 | human Agrin-EGF4 protein | PRT17 |
| SEQ ID NO: 18 | human Agrin-EGF5 protein | PRT18 |
| SEQ ID NO: 19 | human Agrin-EGF6 protein | PRT19 |
| SEQ ID NO: 20 | human All-trans retinoic acid-induced differentiation factor-EGF1 protein | PRT20 |
| SEQ ID NO: 21 | human Alpha-tectorin-EGF1 protein | PRT21 |
| SEQ ID NO: 22 | human Alpha-tectorin-EGF2 protein | PRT22 |
| SEQ ID NO: 23 | human Amphiregulin-EGF1 protein | PRT23 |
| SEQ ID NO: 24 | human Anchor protein-EGF1 protein | PRT24 |
| SEQ ID NO: 25 | human Anchor protein-EGF2 protein | PRT25 |
| SEQ ID NO: 26 | human Anchor protein-EGF3 protein | PRT26 |
| SEQ ID NO: 27 | human Anchor protein-EGF4 protein | PRT27 |
| SEQ ID NO: 28 | human Anchor protein-EGF5 protein | PRT28 |
| SEQ ID NO: 29 | human Anchor protein-EGF6 protein | PRT29 |
| SEQ ID NO: 30 | human Anchor protein-EGF7 protein | PRT30 |
| SEQ ID NO: 31 | human Anchor protein-EGF8 protein | PRT31 |
| SEQ ID NO: 32 | human Angiopoietin-1 receptor-EGF1 protein | PRT32 |
| SEQ ID NO: 33 | human Angiopoietin-1 receptor-EGF2 protein | PRT33 |
| SEQ ID NO: 34 | human Angiopoietin-1 receptor-EGF3 protein | PRT34 |
| SEQ ID NO: 35 | human Astrotactin-1-EGF1 protein | PRT35 |
| SEQ ID NO: 36 | human Astrotactin-1-EGF2 protein | PRT36 |
| SEQ ID NO: 37 | human Astrotactin-1-EGF3 protein | PRT37 |
| SEQ ID NO: 38 | human Astrotactin-2-EGF1 protein | PRT38 |
| SEQ ID NO: 39 | human Astrotactin-2-EGF2 protein | PRT39 |
| SEQ ID NO: 40 | human Astrotactin-2-EGF3 protein | PRT40 |
| SEQ ID NO: 41 | human Attractin-EGF1 protein | PRT41 |
| SEQ ID NO: 42 | human Attractin-EGF2 protein | PRT42 |
| SEQ ID NO: 43 | human Attractin-EGF3 protein | PRT43 |
| SEQ ID NO: 44 | human Attractin-like protein 1-EGF1 protein | PRT44 |
| SEQ ID NO: 45 | human Attractin-like protein 1-EGF2 protein | PRT45 |
| SEQ ID NO: 46 | human Attractin-like protein 1-EGF3 protein | PRT46 |
| SEQ ID NO: 47 | human Attractin-like protein 1-EGF4 protein | PRT47 |
| SEQ ID NO: 48 | human Basement membrane-specific heparan sulfate proteoglycan core protein-EGF1 protein | PRT48 |
| SEQ ID NO: 49 | human Basement membrane-specific heparan sulfate proteoglycan core protein-EGF2 protein | PRT49 |
| SEQ ID NO: 50 | human Basement membrane-specific heparan sulfate proteoglycan core protein-EGF9 protein | PRT50 |
| SEQ ID NO: 51 | human Basement membrane-specific heparan sulfate proteoglycan core protein-EGF10 protein | PRT51 |
| SEQ ID NO: 52 | human Basement membrane-specific heparan sulfate proteoglycan core protein-EGF3 protein | PRT52 |

TABLE 1-continued

Designation of the human-originated EGF domain proteins set forth in the present invention

| No. in the sequence listing | Designation | Code in the invention |
|---|---|---|
| SEQ ID NO: 53 | human Basement membrane-specific heparan sulfate proteoglycan core protein-EGF4 protein | PRT53 |
| SEQ ID NO: 54 | human Basement membrane-specific heparan sulfate proteoglycan core protein-EGF5 protein | PRT54 |
| SEQ ID NO: 55 | human Basement membrane-specific heparan sulfate proteoglycan core protein-EGF6 protein | PRT55 |
| SEQ ID NO: 56 | human Basement membrane-specific heparan sulfate proteoglycan core protein-EGF7 protein | PRT56 |
| SEQ ID NO: 57 | human Basement membrane-specific heparan sulfate proteoglycan core protein-EGF8 protein | PRT57 |
| SEQ ID NO: 58 | human BMP/retinoic acid-inducible neural-specific protein 2-EGF1 protein | PRT58 |
| SEQ ID NO: 59 | human BMP/retinoic acid-inducible neural-specific protein 3-EGF1 protein | PRT59 |
| SEQ ID NO: 60 | human Bone morphogenetic protein 1-EGF1 protein | PRT60 |
| SEQ ID NO: 61 | human Bone morphogenetic protein 1-EGF2 protein | PRT61 |
| SEQ ID NO: 62 | human Brevican core protein-EGF1 protein | PRT62 |
| SEQ ID NO: 63 | human C1q receptor protein-EGF1 protein | PRT63 |
| SEQ ID NO: 64 | human C1q receptor protein-EGF2 protein | PRT64 |
| SEQ ID NO: 65 | human C5R protein-EGF1 protein | PRT65 |
| SEQ ID NO: 66 | human Cadherin EGF LAG seven-pass G-type receptor 1-EGF1 protein | PRT66 |
| SEQ ID NO: 67 | human Cadherin EGF LAG seven-pass G-type receptor 1-EGF2 protein | PRT67 |
| SEQ ID NO: 68 | human Cadherin EGF LAG seven-pass G-type receptor 1-EGF3 protein | PRT68 |
| SEQ ID NO: 69 | human Cadherin EGF LAG seven-pass G-type receptor 1-EGF4 protein | PRT69 |
| SEQ ID NO: 70 | human Cadherin EGF LAG seven-pass G-type receptor 1-EGF5 protein | PRT70 |
| SEQ ID NO: 71 | human Cadherin EGF LAG seven-pass G-type receptor 1-EGF6 protein | PRT71 |
| SEQ ID NO: 72 | human Cadherin EGF LAG seven-pass G-type receptor 1-EGF7 protein | PRT72 |
| SEQ ID NO: 73 | human Cadherin EGF LAG seven-pass G-type receptor 1-EGF8 protein | PRT73 |
| SEQ ID NO: 74 | human Cadherin EGF LAG seven-pass G-type receptor 1-EGF9 protein | PRT74 |
| SEQ ID NO: 75 | human Cadherin EGF LAG seven-pass G-type receptor 2-EGF1 protein | PRT75 |
| SEQ ID NO: 76 | human Cadherin EGF LAG seven-pass G-type receptor 2-EGF2 protein | PRT76 |
| SEQ ID NO: 77 | human Cadherin EGF LAG seven-pass G-type receptor 2-EGF3 protein | PRT77 |
| SEQ ID NO: 78 | human Cadherin EGF LAG seven-pass G-type receptor 2-EGF4 protein | PRT78 |
| SEQ ID NO: 79 | human Cadherin EGF LAG seven-pass G-type receptor 2-EGF5 protein | PRT79 |
| SEQ ID NO: 80 | human Cadherin EGF LAG seven-pass G-type receptor 2-EGF6 protein | PRT80 |
| SEQ ID NO: 81 | human Cadherin EGF LAG seven-pass G-type receptor 2-EGF7 protein | PRT81 |
| SEQ ID NO: 82 | human Cadherin EGF LAG seven-pass G-type receptor 2-EGF8 protein | PRT82 |
| SEQ ID NO: 83 | human Cadherin EGF LAG seven-pass G-type receptor 3-EGF1 protein | PRT83 |
| SEQ ID NO: 84 | human Cadherin EGF LAG seven-pass G-type receptor 3-EGF2 protein | PRT84 |
| SEQ ID NO: 85 | human Cadherin EGF LAG seven-pass G-type receptor 3-EGF3 protein | PRT85 |
| SEQ ID NO: 86 | human Cadherin EGF LAG seven-pass G-type receptor 3-EGF4 protein | PRT86 |
| SEQ ID NO: 87 | human Cadherin EGF LAG seven-pass G-type receptor 3-EGF5 protein | PRT87 |
| SEQ ID NO: 88 | human Cadherin EGF LAG seven-pass G-type receptor 3-EGF6 protein | PRT88 |
| SEQ ID NO: 89 | human Cadherin EGF LAG seven-pass G-type receptor 3-EGF7 protein | PRT89 |
| SEQ ID NO: 90 | human Cadherin EGF LAG seven-pass G-type receptor 3-EGF8 protein | PRT90 |
| SEQ ID NO: 91 | human Cartilage acidic protein 1-EGF1 protein | PRT91 |
| SEQ ID NO: 92 | human Cartilage matrix protein-EGF1 protein | PRT92 |
| SEQ ID NO: 93 | human Cartilage oligomeric matrix protein-EGF1 protein | PRT93 |
| SEQ ID NO: 94 | human Cartilage oligomeric matrix protein-EGF2 protein | PRT94 |
| SEQ ID NO: 95 | human Cartilage oligomeric matrix protein-EGF3 protein | PRT95 |

TABLE 1-continued

Designation of the human-originated EGF domain proteins set forth in the present invention

| No. in the sequence listing | Designation | Code in the invention |
|---|---|---|
| SEQ ID NO: 96 | human Cartilage oligomeric matrix protein-EGF4 protein | PRT96 |
| SEQ ID NO: 97 | human CD97 antigen-EGF1 protein | PRT97 |
| SEQ ID NO: 98 | human CD97 antigen-EGF2 protein | PRT98 |
| SEQ ID NO: 99 | human CD97 antigen-EGF3 protein | PRT99 |
| SEQ ID NO: 100 | human CD97 antigen-EGF4 protein | PRT100 |
| SEQ ID NO: 101 | human CD97 antigen-EGF5 protein | PRT101 |
| SEQ ID NO: 102 | human Cell recognition protein CASPR4-EGF1 protein | PRT102 |
| SEQ ID NO: 103 | human Cell recognition protein CASPR4-EGF2 protein | PRT103 |
| SEQ ID NO: 104 | human Chondroitin sulfate proteoglycan 2 (Versican) variant-EGF1 protein | PRT104 |
| SEQ ID NO: 105 | human Chondroitin sulfate proteoglycan 2 (Versican) variant-EGF2 protein | PRT105 |
| SEQ ID NO: 106 | human Chondroitin sulfate proteoglycan 5-EGF1 protein | PRT106 |
| SEQ ID NO: 107 | human CNTNAP3 protein-EGF1 protein | PRT107 |
| SEQ ID NO: 108 | human Coagulation factor XII-EGF1 protein | PRT108 |
| SEQ ID NO: 109 | human Coagulation factor XII-EGF2 protein | PRT109 |
| SEQ ID NO: 110 | human Collagen and calcium-binding EGF domain-containing protein 1-EGF1 protein | PRT110 |
| SEQ ID NO: 111 | human Complement C1r subcomponent-EGF1 protein | PRT111 |
| SEQ ID NO: 112 | human Complement C1s subcomponent-EGF1 protein | PRT112 |
| SEQ ID NO: 113 | human Complement component 1, r subcomponent, isoform CRA_a-EGF1 protein | PRT113 |
| SEQ ID NO: 114 | human Complement component C1q receptor-EGF1 protein | PRT114 |
| SEQ ID NO: 115 | human Complement component C1q receptor-EGF2 protein | PRT115 |
| SEQ ID NO: 116 | human Complement component C1q receptor-EGF3 protein | PRT116 |
| SEQ ID NO: 117 | human Complement component C1q receptor-EGF4 protein | PRT117 |
| SEQ ID NO: 118 | human Complement component C1q receptor-EGF5 protein | PRT118 |
| SEQ ID NO: 119 | human Complement component C6-EGF1 protein | PRT119 |
| SEQ ID NO: 120 | human Complement component C7-EGF1 protein | PRT120 |
| SEQ ID NO: 121 | human Complement component C8 alpha chain-EGF1 protein | PRT121 |
| SEQ ID NO: 122 | human Complement component C8 beta chain-EGF1 protein | PRT122 |
| SEQ ID NO: 123 | human Complement component C9-EGF1 protein | PRT123 |
| SEQ ID NO: 124 | human Contactin-associated protein 1-EGF1 protein | PRT124 |
| SEQ ID NO: 125 | human Contactin-associated protein 1-EGF2 protein | PRT125 |
| SEQ ID NO: 126 | human Contactin-associated protein-like 2-EGF1 protein | PRT126 |
| SEQ ID NO: 127 | human Contactin-associated protein-like 2-EGF2 protein | PRT127 |
| SEQ ID NO: 128 | human Contactin-associated protein-like 3-EGF1 protein | PRT128 |
| SEQ ID NO: 129 | human Contactin-associated protein-like 3-EGF2 protein | PRT129 |
| SEQ ID NO: 130 | human Contactin-associated protein-like 3B-EGF1 protein | PRT130 |
| SEQ ID NO: 131 | human Contactin-associated protein-like 3B-EGF2 protein | PRT131 |
| SEQ ID NO: 132 | human Contactin-associated protein-like 4-EGF1 protein | PRT132 |
| SEQ ID NO: 133 | human Contactin-associated protein-like 4-EGF2 protein | PRT133 |
| SEQ ID NO: 134 | human Contactin-associated protein-like 5-EGF1 protein | PRT134 |
| SEQ ID NO: 135 | human Contactin-associated protein-like 5-EGF2 protein | PRT135 |
| SEQ ID NO: 136 | human CPXV021 protein-EGF1 protein | PRT136 |
| SEQ ID NO: 137 | human Crumbs homolog 1 isoform II variant-EGF1 protein | PRT137 |
| SEQ ID NO: 138 | human Crumbs homolog 1 isoform II variant-EGF2 protein | PRT138 |
| SEQ ID NO: 139 | human Cryptic family protein 1B-EGF1 protein | PRT139 |
| SEQ ID NO: 140 | human Cryptic protein-EGF1 protein | PRT140 |
| SEQ ID NO: 141 | human CSPG3 variant protein-EGF1 protein | PRT141 |
| SEQ ID NO: 142 | human C-type lectin domain family 14 member A-EGF1 protein | PRT142 |
| SEQ ID NO: 143 | human C-type lectin domain family 18 member A-EGF1 protein | PRT143 |
| SEQ ID NO: 144 | human Cubilin-EGF1 protein | PRT144 |
| SEQ ID NO: 145 | human Cubilin-EGF2 protein | PRT145 |
| SEQ ID NO: 146 | human Cubilin-EGF3 protein | PRT146 |
| SEQ ID NO: 147 | human Cubilin-EGF4 protein | PRT147 |
| SEQ ID NO: 148 | human Cubilin-EGF5 protein | PRT148 |
| SEQ ID NO: 149 | human Cubilin-EGF6 protein | PRT149 |
| SEQ ID NO: 150 | human Cubilin-EGF7 protein | PRT150 |
| SEQ ID NO: 151 | human Cyritestin 2-EGF1 protein | PRT151 |
| SEQ ID NO: 152 | human Cysteine-rich with EGF-like domain protein 1-EGF1 protein | PRT152 |
| SEQ ID NO: 153 | human Cysteine-rich with EGF-like domain protein 2-EGF1 protein | PRT153 |
| SEQ ID NO: 154 | human Cysteine-rich with EGF-like domain protein 2-EGF2 protein | PRT154 |
| SEQ ID NO: 155 | human Delta and Notch-like epidermal growth factor-related-EGF1 protein | PRT155 |
| SEQ ID NO: 156 | human Delta and Notch-like epidermal growth factor-related-EGF10 protein | PRT156 |
| SEQ ID NO: 157 | human Delta and Notch-like epidermal growth factor-related-EGF2 protein | PRT157 |
| SEQ ID NO: 158 | human Delta and Notch-like epidermal growth factor-related-EGF3 protein | PRT158 |
| SEQ ID NO: 159 | human Delta and Notch-like epidermal growth factor-related-EGF4 protein | PRT159 |
| SEQ ID NO: 160 | human Delta and Notch-like epidermal growth factor-related-EGF5 protein | PRT160 |

TABLE 1-continued

Designation of the human-originated EGF domain proteins set forth in the present invention

| No. in the sequence listing | Designation | Code in the invention |
|---|---|---|
| SEQ ID NO: 161 | human Delta and Notch-like epidermal growth factor-related-EGF6 protein | PRT161 |
| SEQ ID NO: 162 | human Delta and Notch-like epidermal growth factor-related-EGF7 protein | PRT162 |
| SEQ ID NO: 163 | human Delta and Notch-like epidermal growth factor-related-EGF8 protein | PRT163 |
| SEQ ID NO: 164 | human Delta and Notch-like epidermal growth factor-related-EGF9 protein | PRT164 |
| SEQ ID NO: 165 | human Delta-like 1-EGF1 protein | PRT165 |
| SEQ ID NO: 166 | human Delta-like 1-EGF2 protein | PRT166 |
| SEQ ID NO: 167 | human Delta-like 1-EGF3 protein | PRT167 |
| SEQ ID NO: 168 | human Delta-like protein 1-EGF1 protein | PRT168 |
| SEQ ID NO: 169 | human Delta-like protein 1-EGF2 protein | PRT169 |
| SEQ ID NO: 170 | human Delta-like protein 1-EGF3 protein | PRT170 |
| SEQ ID NO: 171 | human Delta-like protein 1-EGF4 protein | PRT171 |
| SEQ ID NO: 172 | human Delta-like protein 1-EGF5 protein | PRT172 |
| SEQ ID NO: 173 | human Delta-like protein 1-EGF6 protein | PRT173 |
| SEQ ID NO: 174 | human Delta-like protein 1-EGF7 protein | PRT174 |
| SEQ ID NO: 175 | human Delta-like protein 1-EGF8 protein | PRT175 |
| SEQ ID NO: 176 | human Delta-like protein 3-EGF1 protein | PRT176 |
| SEQ ID NO: 177 | human Delta-like protein 3-EGF2 protein | PRT177 |
| SEQ ID NO: 178 | human Delta-like protein 3-EGF3 protein | PRT178 |
| SEQ ID NO: 179 | human Delta-like protein 3-EGF4 protein | PRT179 |
| SEQ ID NO: 180 | human Delta-like protein 3-EGF5 protein | PRT180 |
| SEQ ID NO: 181 | human Delta-like protein 3-EGF6 protein | PRT181 |
| SEQ ID NO: 182 | human Delta-like protein 4-EGF1 protein | PRT182 |
| SEQ ID NO: 183 | human Delta-like protein 4-EGF2 protein | PRT183 |
| SEQ ID NO: 184 | human Delta-like protein 4-EGF3 protein | PRT184 |
| SEQ ID NO: 185 | human Delta-like protein 4-EGF4 protein | PRT185 |
| SEQ ID NO: 186 | human Delta-like protein 4-EGF5 protein | PRT186 |
| SEQ ID NO: 187 | human Delta-like protein 4-EGF6 protein | PRT187 |
| SEQ ID NO: 188 | human Delta-like protein 4-EGF7 protein | PRT188 |
| SEQ ID NO: 189 | human Delta-like protein 4-EGF8 protein | PRT189 |
| SEQ ID NO: 190 | human DIET1-EGF1 protein | PRT190 |
| SEQ ID NO: 191 | human Diphtheria toxin receptor (Heparin-binding epidermal growth factor-like growth factor) variant-EGF1 protein | PRT191 |
| SEQ ID NO: 192 | human Disintegrin and metalloproteinase domain-containing protein 11-EGF1 protein | PRT192 |
| SEQ ID NO: 193 | human Disintegrin and metalloproteinase domain-containing protein 12-EGF1 protein | PRT193 |
| SEQ ID NO: 194 | human Disintegrin and metalloproteinase domain-containing protein 15-EGF1 protein | PRT194 |
| SEQ ID NO: 195 | human Disintegrin and metalloproteinase domain-containing protein 18-EGF1 protein | PRT195 |
| SEQ ID NO: 196 | human Disintegrin and metalloproteinase domain-containing protein 19-EGF1 protein | PRT196 |
| SEQ ID NO: 197 | human Disintegrin and metalloproteinase domain-containing protein 2-EGF1 protein | PRT197 |
| SEQ ID NO: 198 | human Disintegrin and metalloproteinase domain-containing protein 20-EGF1 protein | PRT198 |
| SEQ ID NO: 199 | human Disintegrin and metalloproteinase domain-containing protein 21-EGF1 protein | PRT199 |
| SEQ ID NO: 200 | human Disintegrin and metalloproteinase domain-containing protein 22-EGF1 protein | PRT200 |
| SEQ ID NO: 201 | human Disintegrin and metalloproteinase domain-containing protein 23-EGF1 protein | PRT201 |
| SEQ ID NO: 202 | human Disintegrin and metalloproteinase domain-containing protein 28-EGF1 protein | PRT202 |
| SEQ ID NO: 203 | human Disintegrin and metalloproteinase domain-containing protein 29-EGF1 protein | PRT203 |
| SEQ ID NO: 204 | human Disintegrin and metalloproteinase domain-containing protein 30-EGF1 protein | PRT204 |
| SEQ ID NO: 205 | human Disintegrin and metalloproteinase domain-containing protein 32-EGF1 protein | PRT205 |
| SEQ ID NO: 206 | human Disintegrin and metalloproteinase domain-containing protein 33-EGF1 protein | PRT206 |
| SEQ ID NO: 207 | human Disintegrin and metalloproteinase domain-containing protein 8-EGF1 protein | PRT207 |
| SEQ ID NO: 208 | human Disintegrin and metalloproteinase domain-containing protein 9-EGF1 protein | PRT208 |
| SEQ ID NO: 209 | human EFEMP2 protein-EGF1 protein | PRT209 |
| SEQ ID NO: 210 | human EFEMP2 protein-EGF2 protein | PRT210 |
| SEQ ID NO: 211 | human EFEMP2 protein-EGF3 protein | PRT211 |
| SEQ ID NO: 212 | human EFEMP2 protein-EGF4 protein | PRT212 |

TABLE 1-continued

Designation of the human-originated EGF domain proteins set forth in the present invention

| No. in the sequence listing | Designation | Code in the invention |
|---|---|---|
| SEQ ID NO: 213 | human EGF, latrophilin and seven transmembrane domain-containing protein 1-EGF1 protein | PRT213 |
| SEQ ID NO: 214 | human EGF, latrophilin and seven transmembrane domain-containing protein 1-EGF2 protein | PRT214 |
| SEQ ID NO: 215 | human EGF-containing fibulin-like extracellular matrix protein 1-EGF1 protein | PRT215 |
| SEQ ID NO: 216 | human EGF-containing fibulin-like extracellular matrix protein 1-EGF2 protein | PRT216 |
| SEQ ID NO: 217 | human EGF-containing fibulin-like extracellular matrix protein 1-EGF3 protein | PRT217 |
| SEQ ID NO: 218 | human EGF-containing fibulin-like extracellular matrix protein 1-EGF4 protein | PRT218 |
| SEQ ID NO: 219 | human EGF-containing fibulin-like extracellular matrix protein 1-EGF5 protein | PRT219 |
| SEQ ID NO: 220 | human EGF-containing fibulin-like extracellular matrix protein 1-EGF6 protein | PRT220 |
| SEQ ID NO: 221 | human EGF-containing fibulin-like extracellular matrix protein 2-EGF1 protein | PRT221 |
| SEQ ID NO: 222 | human EGF-containing fibulin-like extracellular matrix protein 2-EGF2 protein | PRT222 |
| SEQ ID NO: 223 | human EGF-containing fibulin-like extracellular matrix protein 2-EGF3 protein | PRT223 |
| SEQ ID NO: 224 | human EGF-containing fibulin-like extracellular matrix protein 2-EGF4 protein | PRT224 |
| SEQ ID NO: 225 | human EGF-containing fibulin-like extracellular matrix protein 2-EGF5 protein | PRT225 |
| SEQ ID NO: 226 | human EGF-containing fibulin-like extracellular matrix protein 2-EGF6 protein | PRT226 |
| SEQ ID NO: 227 | human EGF-like module-containing mucin-like hormone receptor-like 1-EGF1 protein | PRT227 |
| SEQ ID NO: 228 | human EGF-like module-containing mucin-like hormone receptor-like 1-EGF2 protein | PRT228 |
| SEQ ID NO: 229 | human EGF-like module-containing mucin-like hormone receptor-like 1-EGF3 protein | PRT229 |
| SEQ ID NO: 230 | human EGF-like module-containing mucin-like hormone receptor-like 1-EGF4 protein | PRT230 |
| SEQ ID NO: 231 | human EGF-like module-containing mucin-like hormone receptor-like 1-EGF5 protein | PRT231 |
| SEQ ID NO: 232 | human EGF-like module-containing mucin-like hormone receptor-like 1-EGF6 protein | PRT232 |
| SEQ ID NO: 233 | human EGF-like module-containing mucin-like hormone receptor-like 2-EGF1 protein | PRT233 |
| SEQ ID NO: 234 | human EGF-like module-containing mucin-like hormone receptor-like 2-EGF2 protein | PRT234 |
| SEQ ID NO: 235 | human EGF-like module-containing mucin-like hormone receptor-like 2-EGF3 protein | PRT235 |
| SEQ ID NO: 236 | human EGF-like module-containing mucin-like hormone receptor-like 3-EGF1 protein | PRT236 |
| SEQ ID NO: 237 | human EGF-like module-containing mucin-like hormone receptor-like 3-EGF2 protein | PRT237 |
| SEQ ID NO: 238 | human EGF-like repeat and discoidin I-like domain-containing protein 3-EGF1 protein | PRT238 |
| SEQ ID NO: 239 | human EGF-like repeat and discoidin I-like domain-containing protein 3-EGF2 protein | PRT239 |
| SEQ ID NO: 240 | human EGF-like repeat and discoidin I-like domain-containing protein 3-EGF3 protein | PRT240 |
| SEQ ID NO: 241 | human Endosialin-EGF1 protein | PRT241 |
| SEQ ID NO: 242 | human Epidermal growth factor-like protein 6-EGF1 protein | PRT242 |
| SEQ ID NO: 243 | human Epidermal growth factor-like protein 6-EGF2 protein | PRT243 |
| SEQ ID NO: 244 | human Epidermal growth factor-like protein 6-EGF3 protein | PRT244 |
| SEQ ID NO: 245 | human Epidermal growth factor-like protein 6-EGF4 protein | PRT245 |
| SEQ ID NO: 246 | human Epidermal growth factor-like protein 6-EGF5 protein | PRT246 |
| SEQ ID NO: 247 | human Epidermal growth factor-like protein 7-EGF1 protein | PRT247 |
| SEQ ID NO: 248 | human Epidermal growth factor-like protein 7-EGF2 protein | PRT248 |
| SEQ ID NO: 249 | human Epidermal growth factor-like protein 8-EGF1 protein | PRT249 |
| SEQ ID NO: 250 | human Epidermal growth factor-like protein 8-EGF2 protein | PRT250 |
| SEQ ID NO: 251 | human Epigen-EGF1 protein | PRT251 |
| SEQ ID NO: 252 | human E-selectin-EGF1 protein | PRT252 |
| SEQ ID NO: 253 | human FAT2 protein-EGF1 protein | PRT253 |
| SEQ ID NO: 254 | human FAT2 protein-EGF2 protein | PRT254 |
| SEQ ID NO: 255 | human FBLN7 protein-EGF1 protein | PRT255 |
| SEQ ID NO: 256 | human FEX1-EGF1 protein | PRT256 |
| SEQ ID NO: 257 | human FEX1-EGF10 protein | PRT257 |
| SEQ ID NO: 258 | human FEX1-EGF2 protein | PRT258 |
| SEQ ID NO: 259 | human FEX1-EGF3 protein | PRT259 |

TABLE 1-continued

Designation of the human-originated EGF domain proteins set forth in the present invention

| No. in the sequence listing | Designation | Code in the invention |
| --- | --- | --- |
| SEQ ID NO: 260 | human FEX1-EGF4 protein | PRT260 |
| SEQ ID NO: 261 | human FEX1-EGF5 protein | PRT261 |
| SEQ ID NO: 262 | human FEX1-EGF6 protein | PRT262 |
| SEQ ID NO: 263 | human FEX1-EGF7 protein | PRT263 |
| SEQ ID NO: 264 | human FEX1-EGF8 protein | PRT264 |
| SEQ ID NO: 265 | human FEX1-EGF9 protein | PRT265 |
| SEQ ID NO: 266 | human Fibrillin 15-EGF1 protein | PRT266 |
| SEQ ID NO: 267 | human Fibrillin 15-EGF2 protein | PRT267 |
| SEQ ID NO: 268 | human Fibrillin 15-EGF3 protein | PRT268 |
| SEQ ID NO: 269 | human Fibrillin 15-EGF4 protein | PRT269 |
| SEQ ID NO: 270 | human Fibrillin 15-EGF5 protein | PRT270 |
| SEQ ID NO: 271 | human Fibrillin 15-EGF6 protein | PRT271 |
| SEQ ID NO: 272 | human Fibrillin 15-EGF7 protein | PRT272 |
| SEQ ID NO: 273 | human Fibrillin 15-EGF8 protein | PRT273 |
| SEQ ID NO: 274 | human Fibrillin-1-EGF1 protein | PRT274 |
| SEQ ID NO: 275 | human Fibrillin-1-EGF10 protein | PRT275 |
| SEQ ID NO: 276 | human Fibrillin-1-EGF11 protein | PRT276 |
| SEQ ID NO: 277 | human Fibrillin-1-EGF12 protein | PRT277 |
| SEQ ID NO: 278 | human Fibrillin-1-EGF13 protein | PRT278 |
| SEQ ID NO: 279 | human Fibrillin-1-EGF14 protein | PRT279 |
| SEQ ID NO: 280 | human Fibrillin-1-EGF15 protein | PRT280 |
| SEQ ID NO: 281 | human Fibrillin-1-EGF16 protein | PRT281 |
| SEQ ID NO: 282 | human Fibrillin-1-EGF17 protein | PRT282 |
| SEQ ID NO: 283 | human Fibrillin-1-EGF18 protein | PRT283 |
| SEQ ID NO: 284 | human Fibrillin-1-EGF19 protein | PRT284 |
| SEQ ID NO: 285 | human Fibrillin-1-EGF2 protein | PRT285 |
| SEQ ID NO: 286 | human Fibrillin-1-EGF20 protein | PRT286 |
| SEQ ID NO: 287 | human Fibrillin-1-EGF21 protein | PRT287 |
| SEQ ID NO: 288 | human Fibrillin-1-EGF22 protein | PRT288 |
| SEQ ID NO: 289 | human Fibrillin-1-EGF23 protein | PRT289 |
| SEQ ID NO: 290 | human Fibrillin-1-EGF24 protein | PRT290 |
| SEQ ID NO: 291 | human Fibrillin-1-EGF25 protein | PRT291 |
| SEQ ID NO: 292 | human Fibrillin-1-EGF26 protein | PRT292 |
| SEQ ID NO: 293 | human Fibrillin-1-EGF27 protein | PRT293 |
| SEQ ID NO: 294 | human Fibrillin-1-EGF28 protein | PRT294 |
| SEQ ID NO: 295 | human Fibrillin-1-EGF29 protein | PRT295 |
| SEQ ID NO: 296 | human Fibrillin-1-EGF3 protein | PRT296 |
| SEQ ID NO: 297 | human Fibrillin-1-EGF30 protein | PRT297 |
| SEQ ID NO: 298 | human Fibrillin-1-EGF31 protein | PRT298 |
| SEQ ID NO: 299 | human Fibrillin-1-EGF32 protein | PRT299 |
| SEQ ID NO: 300 | human Fibrillin-1-EGF33 protein | PRT300 |
| SEQ ID NO: 301 | human Fibrillin-1-EGF34 protein | PRT301 |
| SEQ ID NO: 302 | human Fibrillin-1-EGF35 protein | PRT302 |
| SEQ ID NO: 303 | human Fibrillin-1-EGF36 protein | PRT303 |
| SEQ ID NO: 304 | human Fibrillin-1-EGF37 protein | PRT304 |
| SEQ ID NO: 305 | human Fibrillin-1-EGF38 protein | PRT305 |
| SEQ ID NO: 306 | human Fibrillin-1-EGF39 protein | PRT306 |
| SEQ ID NO: 307 | human Fibrillin-1-EGF4 protein | PRT307 |
| SEQ ID NO: 308 | human Fibrillin-1-EGF40 protein | PRT308 |
| SEQ ID NO: 309 | human Fibrillin-1-EGF41 protein | PRT309 |
| SEQ ID NO: 310 | human Fibrillin-1-EGF42 protein | PRT310 |
| SEQ ID NO: 311 | human Fibrillin-1-EGF43 protein | PRT311 |
| SEQ ID NO: 312 | human Fibrillin-1-EGF44 protein | PRT312 |
| SEQ ID NO: 313 | human Fibrillin-1-EGF45 protein | PRT313 |
| SEQ ID NO: 314 | human Fibrillin-1-EGF46 protein | PRT314 |
| SEQ ID NO: 315 | human Fibrillin-1-EGF47 protein | PRT315 |
| SEQ ID NO: 316 | human Fibrillin-1-EGF5 protein | PRT316 |
| SEQ ID NO: 317 | human Fibrillin-1-EGF6 protein | PRT317 |
| SEQ ID NO: 318 | human Fibrillin-1-EGF7 protein | PRT318 |
| SEQ ID NO: 319 | human Fibrillin-1-EGF8 protein | PRT319 |
| SEQ ID NO: 320 | human Fibrillin-1-EGF9 protein | PRT320 |
| SEQ ID NO: 321 | human Fibrillin-2-EGF1 protein | PRT321 |
| SEQ ID NO: 322 | human Fibrillin-2-EGF10 protein | PRT322 |
| SEQ ID NO: 323 | human Fibrillin-2-EGF11 protein | PRT323 |
| SEQ ID NO: 324 | human Fibrillin-2-EGF12 protein | PRT324 |
| SEQ ID NO: 325 | human Fibrillin-2-EGF13 protein | PRT325 |
| SEQ ID NO: 326 | human Fibrillin-2-EGF14 protein | PRT326 |
| SEQ ID NO: 327 | human Fibrillin-2-EGF15 protein | PRT327 |
| SEQ ID NO: 328 | human Fibrillin-2-EGF16 protein | PRT328 |
| SEQ ID NO: 329 | human Fibrillin-2-EGF17 protein | PRT329 |
| SEQ ID NO: 330 | human Fibrillin-2-EGF18 protein | PRT330 |
| SEQ ID NO: 331 | human Fibrillin-2-EGF19 protein | PRT331 |
| SEQ ID NO: 332 | human Fibrillin-2-EGF2 protein | PRT332 |
| SEQ ID NO: 333 | human Fibrillin-2-EGF20 protein | PRT333 |
| SEQ ID NO: 334 | human Fibrillin-2-EGF21 protein | PRT334 |

TABLE 1-continued

Designation of the human-originated EGF domain proteins set forth in the present invention

| No. in the sequence listing | Designation | Code in the invention |
|---|---|---|
| SEQ ID NO: 335 | human Fibrillin-2-EGF22 protein | PRT335 |
| SEQ ID NO: 336 | human Fibrillin-2-EGF23 protein | PRT336 |
| SEQ ID NO: 337 | human Fibrillin-2-EGF24 protein | PRT337 |
| SEQ ID NO: 338 | human Fibrillin-2-EGF25 protein | PRT338 |
| SEQ ID NO: 339 | human Fibrillin-2-EGF26 protein | PRT339 |
| SEQ ID NO: 340 | human Fibrillin-2-EGF27 protein | PRT340 |
| SEQ ID NO: 341 | human Fibrillin-2-EGF28 protein | PRT341 |
| SEQ ID NO: 342 | human Fibrillin-2-EGF29 protein | PRT342 |
| SEQ ID NO: 343 | human Fibrillin-2-EGF3 protein | PRT343 |
| SEQ ID NO: 344 | human Fibrillin-2-EGF30 protein | PRT344 |
| SEQ ID NO: 345 | human Fibrillin-2-EGF31 protein | PRT345 |
| SEQ ID NO: 346 | human Fibrillin-2-EGF32 protein | PRT346 |
| SEQ ID NO: 347 | human Fibrillin-2-EGF33 protein | PRT347 |
| SEQ ID NO: 348 | human Fibrillin-2-EGF34 protein | PRT348 |
| SEQ ID NO: 349 | human Fibrillin-2-EGF35 protein | PRT349 |
| SEQ ID NO: 350 | human Fibrillin-2-EGF36 protein | PRT350 |
| SEQ ID NO: 351 | human Fibrillin-2-EGF37 protein | PRT351 |
| SEQ ID NO: 352 | human Fibrillin-2-EGF38 protein | PRT352 |
| SEQ ID NO: 353 | human Fibrillin-2-EGF39 protein | PRT353 |
| SEQ ID NO: 354 | human Fibrillin-2-EGF4 protein | PRT354 |
| SEQ ID NO: 355 | human Fibrillin-2-EGF40 protein | PRT355 |
| SEQ ID NO: 356 | human Fibrillin-2-EGF41 protein | PRT356 |
| SEQ ID NO: 357 | human Fibrillin-2-EGF42 protein | PRT357 |
| SEQ ID NO: 358 | human Fibrillin-2-EGF43 protein | PRT358 |
| SEQ ID NO: 359 | human Fibrillin-2-EGF44 protein | PRT359 |
| SEQ ID NO: 360 | human Fibrillin-2-EGF45 protein | PRT360 |
| SEQ ID NO: 361 | human Fibrillin-2-EGF46 protein | PRT361 |
| SEQ ID NO: 362 | human Fibrillin-2-EGF47 protein | PRT362 |
| SEQ ID NO: 363 | human Fibrillin-2-EGF5 protein | PRT363 |
| SEQ ID NO: 364 | human Fibrillin-2-EGF6 protein | PRT364 |
| SEQ ID NO: 365 | human Fibrillin-2-EGF7 protein | PRT365 |
| SEQ ID NO: 366 | human Fibrillin-2-EGF8 protein | PRT366 |
| SEQ ID NO: 367 | human Fibrillin-2-EGF9 protein | PRT367 |
| SEQ ID NO: 368 | human Fibrillin-3-EGF1 protein | PRT368 |
| SEQ ID NO: 369 | human Fibrillin-3-EGF10 protein | PRT369 |
| SEQ ID NO: 370 | human Fibrillin-3-EGF11 protein | PRT370 |
| SEQ ID NO: 371 | human Fibrillin-3-EGF12 protein | PRT371 |
| SEQ ID NO: 372 | human Fibrillin-3-EGF13 protein | PRT372 |
| SEQ ID NO: 373 | human Fibrillin-3-EGF14 protein | PRT373 |
| SEQ ID NO: 374 | human Fibrillin-3-EGF15 protein | PRT374 |
| SEQ ID NO: 375 | human Fibrillin-3-EGF16 protein | PRT375 |
| SEQ ID NO: 376 | human Fibrillin-3-EGF17 protein | PRT376 |
| SEQ ID NO: 377 | human Fibrillin-3-EGF18 protein | PRT377 |
| SEQ ID NO: 378 | human Fibrillin-3-EGF19 protein | PRT378 |
| SEQ ID NO: 379 | human Fibrillin-3-EGF2 protein | PRT379 |
| SEQ ID NO: 380 | human Fibrillin-3-EGF20 protein | PRT380 |
| SEQ ID NO: 381 | human Fibrillin-3-EGF21 protein | PRT381 |
| SEQ ID NO: 382 | human Fibrillin-3-EGF22 protein | PRT382 |
| SEQ ID NO: 383 | human Fibrillin-3-EGF23 protein | PRT383 |
| SEQ ID NO: 384 | human Fibrillin-3-EGF24 protein | PRT384 |
| SEQ ID NO: 385 | human Fibrillin-3-EGF25 protein | PRT385 |
| SEQ ID NO: 386 | human Fibrillin-3-EGF26 protein | PRT386 |
| SEQ ID NO: 387 | human Fibrillin-3-EGF27 protein | PRT387 |
| SEQ ID NO: 388 | human Fibrillin-3-EGF28 protein | PRT388 |
| SEQ ID NO: 389 | human Fibrillin-3-EGF29 protein | PRT389 |
| SEQ ID NO: 390 | human Fibrillin-3-EGF3 protein | PRT390 |
| SEQ ID NO: 391 | human Fibrillin-3-EGF30 protein | PRT391 |
| SEQ ID NO: 392 | human Fibrillin-3-EGF31 protein | PRT392 |
| SEQ ID NO: 393 | human Fibrillin-3-EGF32 protein | PRT393 |
| SEQ ID NO: 394 | human Fibrillin-3-EGF33 protein | PRT394 |
| SEQ ID NO: 395 | human Fibrillin-3-EGF34 protein | PRT395 |
| SEQ ID NO: 396 | human Fibrillin-3-EGF35 protein | PRT396 |
| SEQ ID NO: 397 | human Fibrillin-3-EGF36 protein | PRT397 |
| SEQ ID NO: 398 | human Fibrillin-3-EGF37 protein | PRT398 |
| SEQ ID NO: 399 | human Fibrillin-3-EGF38 protein | PRT399 |
| SEQ ID NO: 400 | human Fibrillin-3-EGF39 protein | PRT400 |
| SEQ ID NO: 401 | human Fibrillin-3-EGF4 protein | PRT401 |
| SEQ ID NO: 402 | human Fibrillin-3-EGF40 protein | PRT402 |
| SEQ ID NO: 403 | human Fibrillin-3-EGF41 protein | PRT403 |
| SEQ ID NO: 404 | human Fibrillin-3-EGF42 protein | PRT404 |
| SEQ ID NO: 405 | human Fibrillin-3-EGF43 protein | PRT405 |
| SEQ ID NO: 406 | human Fibrillin-3-EGF44 protein | PRT406 |
| SEQ ID NO: 407 | human Fibrillin-3-EGF5 protein | PRT407 |
| SEQ ID NO: 408 | human Fibrillin-3-EGF6 protein | PRT408 |
| SEQ ID NO: 409 | human Fibrillin-3-EGF7 protein | PRT409 |

TABLE 1-continued

Designation of the human-originated EGF domain proteins set forth in the present invention

| No. in the sequence listing | Designation | Code in the invention |
|---|---|---|
| SEQ ID NO: 410 | human Fibrillin-3-EGF8 protein | PRT410 |
| SEQ ID NO: 411 | human Fibrillin-3-EGF9 protein | PRT411 |
| SEQ ID NO: 412 | human Fibulin-1-EGF1 protein | PRT412 |
| SEQ ID NO: 413 | human Fibulin-1-EGF2 protein | PRT413 |
| SEQ ID NO: 414 | human Fibulin-1-EGF3 protein | PRT414 |
| SEQ ID NO: 415 | human Fibulin-1-EGF4 protein | PRT415 |
| SEQ ID NO: 416 | human Fibulin-1-EGF5 protein | PRT416 |
| SEQ ID NO: 417 | human Fibulin-1-EGF6 protein | PRT417 |
| SEQ ID NO: 418 | human Fibulin-1-EGF7 protein | PRT418 |
| SEQ ID NO: 419 | human Fibulin-1-EGF8 protein | PRT419 |
| SEQ ID NO: 420 | human Fibulin-1-EGF9 protein | PRT420 |
| SEQ ID NO: 421 | human Fibulin-2-EGF1 protein | PRT421 |
| SEQ ID NO: 422 | human Fibulin-2-EGF10 protein | PRT422 |
| SEQ ID NO: 423 | human Fibulin-2-EGF2 protein | PRT423 |
| SEQ ID NO: 424 | human Fibulin-2-EGF3 protein | PRT424 |
| SEQ ID NO: 425 | human Fibulin-2-EGF4 protein | PRT425 |
| SEQ ID NO: 426 | human Fibulin-2-EGF5 protein | PRT426 |
| SEQ ID NO: 427 | human Fibulin-2-EGF6 protein | PRT427 |
| SEQ ID NO: 428 | human Fibulin-2-EGF7 protein | PRT428 |
| SEQ ID NO: 429 | human Fibulin-2-EGF8 protein | PRT429 |
| SEQ ID NO: 430 | human Fibulin-2-EGF9 protein | PRT430 |
| SEQ ID NO: 431 | human Fibulin-5-EGF1 protein | PRT431 |
| SEQ ID NO: 432 | human Fibulin-5-EGF2 protein | PRT432 |
| SEQ ID NO: 433 | human Fibulin-5-EGF3 protein | PRT433 |
| SEQ ID NO: 434 | human Fibulin-5-EGF4 protein | PRT434 |
| SEQ ID NO: 435 | human Fibulin-5-EGF5 protein | PRT435 |
| SEQ ID NO: 436 | human Fibulin-5-EGF6 protein | PRT436 |
| SEQ ID NO: 437 | human Fibulin-6-EGF1 protein | PRT437 |
| SEQ ID NO: 438 | human Fibulin-6-EGF2 protein | PRT438 |
| SEQ ID NO: 439 | human Fibulin-6-EGF3 protein | PRT439 |
| SEQ ID NO: 440 | human Fibulin-6-EGF4 protein | PRT440 |
| SEQ ID NO: 441 | human Fibulin-6-EGF5 protein | PRT441 |
| SEQ ID NO: 442 | human Fibulin-6-EGF6 protein | PRT442 |
| SEQ ID NO: 443 | human Fibulin-6-EGF7 protein | PRT443 |
| SEQ ID NO: 444 | human Fibulin-7-EGF1 protein | PRT444 |
| SEQ ID NO: 445 | human Fibulin-7-EGF2 protein | PRT445 |
| SEQ ID NO: 446 | human Fibulin-7-EGF3 protein | PRT446 |
| SEQ ID NO: 447 | human Fibulin-like extracellular matrix protein-EGF1 protein | PRT447 |
| SEQ ID NO: 448 | human Fibulin-like extracellular matrix protein-EGF2 protein | PRT448 |
| SEQ ID NO: 449 | human Fibulin-like extracellular matrix protein-EGF3 protein | PRT449 |
| SEQ ID NO: 450 | human Glycoprotein receptor gp330/megalin-EGF1 protein | PRT450 |
| SEQ ID NO: 451 | human Glycoprotein receptor gp330/megalin-EGF2 protein | PRT451 |
| SEQ ID NO: 452 | human Glycoprotein receptor gp330/megalin-EGF3 protein | PRT452 |
| SEQ ID NO: 453 | human Glycoprotein receptor gp330/megalin-EGF4 protein | PRT453 |
| SEQ ID NO: 454 | human Growth arrest-specific protein 6-EGF1 protein | PRT454 |
| SEQ ID NO: 455 | human Growth arrest-specific protein 6-EGF2 protein | PRT455 |
| SEQ ID NO: 456 | human Growth arrest-specific protein 6-EGF3 protein | PRT456 |
| SEQ ID NO: 457 | human Growth arrest-specific protein 6-EGF4 protein | PRT457 |
| SEQ ID NO: 458 | human Hedgehog-interacting protein-EGF1 protein | PRT458 |
| SEQ ID NO: 459 | human Hedgehog-interacting protein-EGF2 protein | PRT459 |
| SEQ ID NO: 460 | human Hemicentin-2-EGF1 protein | PRT460 |
| SEQ ID NO: 461 | human Hemicentin-2-EGF2 protein | PRT461 |
| SEQ ID NO: 462 | human Hemicentin-2-EGF3 protein | PRT462 |
| SEQ ID NO: 463 | human Hemicentin-2-EGF4 protein | PRT463 |
| SEQ ID NO: 464 | human Hemicentin-2-EGF5 protein | PRT464 |
| SEQ ID NO: 465 | human Hepatocyte growth factor activator-EGF1 protein | PRT465 |
| SEQ ID NO: 466 | human Hepatocyte growth factor activator-EGF2 protein | PRT466 |
| SEQ ID NO: 467 | human HMGA2ex3/WIF1ex3 fusion protein-EGF1 protein | PRT467 |
| SEQ ID NO: 468 | human HMGA2ex3/WIF1ex3 fusion protein-EGF2 protein | PRT468 |
| SEQ ID NO: 469 | human HMGA2ex3/WIF1ex3 fusion protein-EGF3 protein | PRT469 |
| SEQ ID NO: 470 | human HMGA2ex3/WIF1ex3 fusion protein-EGF4 protein | PRT470 |
| SEQ ID NO: 471 | human HMGA2ex3/WIF1ex3 fusion protein-EGF5 protein | PRT471 |
| SEQ ID NO: 472 | human HSPG2 protein-EGF1 protein | PRT472 |
| SEQ ID NO: 473 | human HSPG2 protein-EGF2 protein | PRT473 |
| SEQ ID NO: 474 | human Hyaluronan-binding protein 2-EGF1 protein | PRT474 |
| SEQ ID NO: 475 | human Hyaluronan-binding protein 2-EGF2 protein | PRT475 |
| SEQ ID NO: 476 | human Hyaluronan-binding protein 2-EGF3 protein | PRT476 |
| SEQ ID NO: 477 | human Hyaluronidase-1-EGF1 protein | PRT477 |
| SEQ ID NO: 478 | human Hyaluronidase-2-EGF1 protein | PRT478 |
| SEQ ID NO: 479 | human Hyaluronidase-3-EGF1 protein | PRT479 |
| SEQ ID NO: 480 | human Hyaluronidase-4-EGF1 protein | PRT480 |
| SEQ ID NO: 481 | human Inactive serine protease PAMR1-EGF1 protein | PRT481 |
| SEQ ID NO: 482 | human Integrin beta-like protein 1-EGF1 protein | PRT482 |
| SEQ ID NO: 483 | human Integrin beta-like protein 1-EGF2 protein | PRT483 |
| SEQ ID NO: 484 | human Integrin beta-like protein 1-EGF3 protein | PRT484 |

TABLE 1-continued

Designation of the human-originated EGF domain proteins set forth in the present invention

| No. in the sequence listing | Designation | Code in the invention |
|---|---|---|
| SEQ ID NO: 485 | human Interphotoreceptor matrix proteoglycan 1, isoform CRA_a-EGF1 protein | PRT485 |
| SEQ ID NO: 486 | human Interphotoreceptor matrix proteoglycan 2-EGF1 protein | PRT486 |
| SEQ ID NO: 487 | human Interphotoreceptor matrix proteoglycan 2-EGF2 protein | PRT487 |
| SEQ ID NO: 488 | human Intestinal mucin-EGF1 protein | PRT488 |
| SEQ ID NO: 489 | human Intestinal mucin-EGF2 protein | PRT489 |
| SEQ ID NO: 490 | human KIAA0921 splice variant 1-EGF1 protein | PRT490 |
| SEQ ID NO: 491 | human Lactadherin-EGF1 protein | PRT491 |
| SEQ ID NO: 492 | human Laminin subunit alpha-1-EGF1 protein | PRT492 |
| SEQ ID NO: 493 | human Laminin subunit alpha-1-EGF10 protein | PRT493 |
| SEQ ID NO: 494 | human Laminin subunit alpha-1-EGF11 protein | PRT494 |
| SEQ ID NO: 495 | human Laminin subunit alpha-1-EGF12 protein | PRT495 |
| SEQ ID NO: 496 | human Laminin subunit alpha-1-EGF13 protein | PRT496 |
| SEQ ID NO: 497 | human Laminin subunit alpha-1-EGF14 protein | PRT497 |
| SEQ ID NO: 498 | human Laminin subunit alpha-1-EGF15 protein | PRT498 |
| SEQ ID NO: 499 | human Laminin subunit alpha-1-EGF2 protein | PRT499 |
| SEQ ID NO: 500 | human Laminin subunit alpha-1-EGF3 protein | PRT500 |
| SEQ ID NO: 501 | human Laminin subunit alpha-1-EGF4 protein | PRT501 |
| SEQ ID NO: 502 | human Laminin subunit alpha-1-EGF5 protein | PRT502 |
| SEQ ID NO: 503 | human Laminin subunit alpha-1-EGF6 protein | PRT503 |
| SEQ ID NO: 504 | human Laminin subunit alpha-1-EGF7 protein | PRT504 |
| SEQ ID NO: 505 | human Laminin subunit alpha-1-EGF8 protein | PRT505 |
| SEQ ID NO: 506 | human Laminin subunit alpha-1-EGF9 protein | PRT506 |
| SEQ ID NO: 507 | human Laminin subunit alpha-2-EGF1 protein | PRT507 |
| SEQ ID NO: 508 | human Laminin subunit alpha-2-EGF10 protein | PRT508 |
| SEQ ID NO: 509 | human Laminin subunit alpha-2-EGF11 protein | PRT509 |
| SEQ ID NO: 510 | human Laminin subunit alpha-2-EGF12 protein | PRT510 |
| SEQ ID NO: 511 | human Laminin subunit alpha-2-EGF13 protein | PRT511 |
| SEQ ID NO: 512 | human Laminin subunit alpha-2-EGF14 protein | PRT512 |
| SEQ ID NO: 513 | human Laminin subunit alpha-2-EGF15 protein | PRT513 |
| SEQ ID NO: 514 | human Laminin subunit alpha-2-EGF2 protein | PRT514 |
| SEQ ID NO: 515 | human Laminin subunit alpha-2-EGF3 protein | PRT515 |
| SEQ ID NO: 516 | human Laminin subunit alpha-2-EGF4 protein | PRT516 |
| SEQ ID NO: 517 | human Laminin subunit alpha-2-EGF5 protein | PRT517 |
| SEQ ID NO: 518 | human Laminin subunit alpha-2-EGF6 protein | PRT518 |
| SEQ ID NO: 519 | human Laminin subunit alpha-2-EGF7 protein | PRT519 |
| SEQ ID NO: 520 | human Laminin subunit alpha-2-EGF8 protein | PRT520 |
| SEQ ID NO: 521 | human Laminin subunit alpha-2-EGF9 protein | PRT521 |
| SEQ ID NO: 522 | human Laminin subunit alpha-3-EGF1 protein | PRT522 |
| SEQ ID NO: 523 | human Laminin subunit alpha-3-EGF10 protein | PRT523 |
| SEQ ID NO: 524 | human Laminin subunit alpha-3-EGF11 protein | PRT524 |
| SEQ ID NO: 525 | human Laminin subunit alpha-3-EGF12 protein | PRT525 |
| SEQ ID NO: 526 | human Laminin subunit alpha-3-EGF13 protein | PRT526 |
| SEQ ID NO: 527 | human Laminin subunit alpha-3-EGF14 protein | PRT527 |
| SEQ ID NO: 528 | human Laminin subunit alpha-3-EGF15 protein | PRT528 |
| SEQ ID NO: 529 | human Laminin subunit alpha-3-EGF2 protein | PRT529 |
| SEQ ID NO: 530 | human Laminin subunit alpha-3-EGF3 protein | PRT530 |
| SEQ ID NO: 531 | human Laminin subunit alpha-3-EGF4 protein | PRT531 |
| SEQ ID NO: 532 | human Laminin subunit alpha-3-EGF5 protein | PRT532 |
| SEQ ID NO: 533 | human Laminin subunit alpha-3-EGF6 protein | PRT533 |
| SEQ ID NO: 534 | human Laminin subunit alpha-3-EGF7 protein | PRT534 |
| SEQ ID NO: 535 | human Laminin subunit alpha-3-EGF8 protein | PRT535 |
| SEQ ID NO: 536 | human Laminin subunit alpha-3-EGF9 protein | PRT536 |
| SEQ ID NO: 537 | human Laminin subunit alpha-4-EGF1 protein | PRT537 |
| SEQ ID NO: 538 | human Laminin subunit alpha-4-EGF2 protein | PRT538 |
| SEQ ID NO: 539 | human Laminin subunit alpha-4-EGF3 protein | PRT539 |
| SEQ ID NO: 540 | human Laminin subunit alpha-5-EGF1 protein | PRT540 |
| SEQ ID NO: 541 | human Laminin subunit alpha-5-EGF10 protein | PRT541 |
| SEQ ID NO: 542 | human Laminin subunit alpha-5-EGF11 protein | PRT542 |
| SEQ ID NO: 543 | human Laminin subunit alpha-5-EGF12 protein | PRT543 |
| SEQ ID NO: 544 | human Laminin subunit alpha-5-EGF13 protein | PRT544 |
| SEQ ID NO: 545 | human Laminin subunit alpha-5-EGF14 protein | PRT545 |
| SEQ ID NO: 546 | human Laminin subunit alpha-5-EGF15 protein | PRT546 |
| SEQ ID NO: 547 | human Laminin subunit alpha-5-EGF16 protein | PRT547 |
| SEQ ID NO: 548 | human Laminin subunit alpha-5-EGF17 protein | PRT548 |
| SEQ ID NO: 549 | human Laminin subunit alpha-5-EGF18 protein | PRT549 |
| SEQ ID NO: 550 | human Laminin subunit alpha-5-EGF19 protein | PRT550 |
| SEQ ID NO: 551 | human Laminin subunit alpha-5-EGF2 protein | PRT551 |
| SEQ ID NO: 552 | human Laminin subunit alpha-5-EGF20 protein | PRT552 |
| SEQ ID NO: 553 | human Laminin subunit alpha-5-EGF21 protein | PRT553 |
| SEQ ID NO: 554 | human Laminin subunit alpha-5-EGF3 protein | PRT554 |
| SEQ ID NO: 555 | human Laminin subunit alpha-5-EGF4 protein | PRT555 |
| SEQ ID NO: 556 | human Laminin subunit alpha-5-EGF5 protein | PRT556 |
| SEQ ID NO: 557 | human Laminin subunit alpha-5-EGF6 protein | PRT557 |
| SEQ ID NO: 558 | human Laminin subunit alpha-5-EGF7 protein | PRT558 |

TABLE 1-continued

Designation of the human-originated EGF domain proteins set forth in the present invention

| No. in the sequence listing | Designation | Code in the invention |
|---|---|---|
| SEQ ID NO: 559 | human Laminin subunit alpha-5-EGF8 protein | PRT559 |
| SEQ ID NO: 560 | human Laminin subunit alpha-5-EGF9 protein | PRT560 |
| SEQ ID NO: 561 | human Laminin subunit beta-1-EGF1 protein | PRT561 |
| SEQ ID NO: 562 | human Laminin subunit beta-1-EGF10 protein | PRT562 |
| SEQ ID NO: 563 | human Laminin subunit beta-1-EGF11 protein | PRT563 |
| SEQ ID NO: 564 | human Laminin subunit beta-1-EGF12 protein | PRT564 |
| SEQ ID NO: 565 | human Laminin subunit beta-1-EGF13 protein | PRT565 |
| SEQ ID NO: 566 | human Laminin subunit beta-1-EGF2 protein | PRT566 |
| SEQ ID NO: 567 | human Laminin subunit beta-1-EGF3 protein | PRT567 |
| SEQ ID NO: 568 | human Laminin subunit beta-1-EGF4 protein | PRT568 |
| SEQ ID NO: 569 | human Laminin subunit beta-1-EGF5 protein | PRT569 |
| SEQ ID NO: 570 | human Laminin subunit beta-1-EGF6 protein | PRT570 |
| SEQ ID NO: 571 | human Laminin subunit beta-1-EGF7 protein | PRT571 |
| SEQ ID NO: 572 | human Laminin subunit beta-1-EGF8 protein | PRT572 |
| SEQ ID NO: 573 | human Laminin subunit beta-1-EGF9 protein | PRT573 |
| SEQ ID NO: 574 | human Laminin subunit beta-2-EGF1 protein | PRT574 |
| SEQ ID NO: 575 | human Laminin subunit beta-2-EGF10 protein | PRT575 |
| SEQ ID NO: 576 | human Laminin subunit beta-2-EGF11 protein | PRT576 |
| SEQ ID NO: 577 | human Laminin subunit beta-2-EGF12 protein | PRT577 |
| SEQ ID NO: 578 | human Laminin subunit beta-2-EGF13 protein | PRT578 |
| SEQ ID NO: 579 | human Laminin subunit beta-2-EGF2 protein | PRT579 |
| SEQ ID NO: 580 | human Laminin subunit beta-2-EGF3 protein | PRT580 |
| SEQ ID NO: 581 | human Laminin subunit beta-2-EGF4 protein | PRT581 |
| SEQ ID NO: 582 | human Laminin subunit beta-2-EGF5 protein | PRT582 |
| SEQ ID NO: 583 | human Laminin subunit beta-2-EGF6 protein | PRT583 |
| SEQ ID NO: 584 | human Laminin subunit beta-2-EGF7 protein | PRT584 |
| SEQ ID NO: 585 | human Laminin subunit beta-2-EGF8 protein | PRT585 |
| SEQ ID NO: 586 | human Laminin subunit beta-2-EGF9 protein | PRT586 |
| SEQ ID NO: 587 | human Laminin subunit beta-3-EGF1 protein | PRT587 |
| SEQ ID NO: 588 | human Laminin subunit beta-3-EGF2 protein | PRT588 |
| SEQ ID NO: 589 | human Laminin subunit beta-3-EGF3 protein | PRT589 |
| SEQ ID NO: 590 | human Laminin subunit beta-3-EGF4 protein | PRT590 |
| SEQ ID NO: 591 | human Laminin subunit beta-3-EGF5 protein | PRT591 |
| SEQ ID NO: 592 | human Laminin subunit beta-3-EGF6 protein | PRT592 |
| SEQ ID NO: 593 | human Laminin subunit beta-4-EGF1 protein | PRT593 |
| SEQ ID NO: 594 | human Laminin subunit beta-4-EGF10 protein | PRT594 |
| SEQ ID NO: 595 | human Laminin subunit beta-4-EGF11 protein | PRT595 |
| SEQ ID NO: 596 | human Laminin subunit beta-4-EGF12 protein | PRT596 |
| SEQ ID NO: 597 | human Laminin subunit beta-4-EGF13 protein | PRT597 |
| SEQ ID NO: 598 | human Laminin subunit beta-4-EGF2 protein | PRT598 |
| SEQ ID NO: 599 | human Laminin subunit beta-4-EGF3 protein | PRT599 |
| SEQ ID NO: 600 | human Laminin subunit beta-4-EGF4 protein | PRT600 |
| SEQ ID NO: 601 | human Laminin subunit beta-4-EGF5 protein | PRT601 |
| SEQ ID NO: 602 | human Laminin subunit beta-4-EGF6 protein | PRT602 |
| SEQ ID NO: 603 | human Laminin subunit beta-4-EGF7 protein | PRT603 |
| SEQ ID NO: 604 | human Laminin subunit beta-4-EGF8 protein | PRT604 |
| SEQ ID NO: 605 | human Laminin subunit beta-4-EGF9 protein | PRT605 |
| SEQ ID NO: 606 | human Laminin subunit gamma-1-EGF1 protein | PRT606 |
| SEQ ID NO: 607 | human Laminin subunit gamma-1-EGF10 protein | PRT607 |
| SEQ ID NO: 608 | human Laminin subunit gamma-1-EGF2 protein | PRT608 |
| SEQ ID NO: 609 | human Laminin subunit gamma-1-EGF3 protein | PRT609 |
| SEQ ID NO: 610 | human Laminin subunit gamma-1-EGF4 protein | PRT610 |
| SEQ ID NO: 611 | human Laminin subunit gamma-1-EGF5 protein | PRT611 |
| SEQ ID NO: 612 | human Laminin subunit gamma-1-EGF6 protein | PRT612 |
| SEQ ID NO: 613 | human Laminin subunit gamma-1-EGF7 protein | PRT613 |
| SEQ ID NO: 614 | human Laminin subunit gamma-1-EGF8 protein | PRT614 |
| SEQ ID NO: 615 | human Laminin subunit gamma-1-EGF9 protein | PRT615 |
| SEQ ID NO: 616 | human Laminin subunit gamma-2-EGF1 protein | PRT616 |
| SEQ ID NO: 617 | human Laminin subunit gamma-2-EGF2 protein | PRT617 |
| SEQ ID NO: 618 | human Laminin subunit gamma-2-EGF3 protein | PRT618 |
| SEQ ID NO: 619 | human Laminin subunit gamma-2-EGF4 protein | PRT619 |
| SEQ ID NO: 620 | human Laminin subunit gamma-2-EGF5 protein | PRT620 |
| SEQ ID NO: 621 | human Laminin subunit gamma-2-EGF6 protein | PRT621 |
| SEQ ID NO: 622 | human Laminin subunit gamma-2-EGF7 protein | PRT622 |
| SEQ ID NO: 623 | human Laminin subunit gamma-3-EGF1 protein | PRT623 |
| SEQ ID NO: 624 | human Laminin subunit gamma-3-EGF10 protein | PRT624 |
| SEQ ID NO: 625 | human Laminin subunit gamma-3-EGF2 protein | PRT625 |
| SEQ ID NO: 626 | human Laminin subunit gamma-3-EGF3 protein | PRT626 |
| SEQ ID NO: 627 | human Laminin subunit gamma-3-EGF4 protein | PRT627 |
| SEQ ID NO: 628 | human Laminin subunit gamma-3-EGF5 protein | PRT628 |
| SEQ ID NO: 629 | human Laminin subunit gamma-3-EGF6 protein | PRT629 |
| SEQ ID NO: 630 | human Laminin subunit gamma-3-EGF7 protein | PRT630 |
| SEQ ID NO: 631 | human Laminin subunit gamma-3-EGF8 protein | PRT631 |
| SEQ ID NO: 632 | human Laminin subunit gamma-3-EGF9 protein | PRT632 |

TABLE 1-continued

Designation of the human-originated EGF domain proteins set forth in the present invention

| No. in the sequence listing | Designation | Code in the invention |
|---|---|---|
| SEQ ID NO: 633 | human Latent-transforming growth factor beta-binding protein 1-EGF1 protein | PRT633 |
| SEQ ID NO: 634 | human Latent-transforming growth factor beta-binding protein 1-EGF10 protein | PRT634 |
| SEQ ID NO: 635 | human Latent-transforming growth factor beta-binding protein 1-EGF11 protein | PRT635 |
| SEQ ID NO: 636 | human Latent-transforming growth factor beta-binding protein 1-EGF12 protein | PRT636 |
| SEQ ID NO: 637 | human Latent-transforming growth factor beta-binding protein 1-EGF13 protein | PRT637 |
| SEQ ID NO: 638 | human Latent-transforming growth factor beta-binding protein 1-EGF14 protein | PRT638 |
| SEQ ID NO: 639 | human Latent-transforming growth factor beta-binding protein 1-EGF15 protein | PRT639 |
| SEQ ID NO: 640 | human Latent-transforming growth factor beta-binding protein 1-EGF16 protein | PRT640 |
| SEQ ID NO: 641 | human Latent-transforming growth factor beta-binding protein 1-EGF17 protein | PRT641 |
| SEQ ID NO: 642 | human Latent-transforming growth factor beta-binding protein 1-EGF18 protein | PRT642 |
| SEQ ID NO: 643 | human Latent-transforming growth factor beta-binding protein 1-EGF2 protein | PRT643 |
| SEQ ID NO: 644 | human Latent-transforming growth factor beta-binding protein 1-EGF3 protein | PRT644 |
| SEQ ID NO: 645 | human Latent-transforming growth factor beta-binding protein 1-EGF4 protein | PRT645 |
| SEQ ID NO: 646 | human Latent-transforming growth factor beta-binding protein 1-EGF5 protein | PRT646 |
| SEQ ID NO: 647 | human Latent-transforming growth factor beta-binding protein 1-EGF6 protein | PRT647 |
| SEQ ID NO: 648 | human Latent-transforming growth factor beta-binding protein 1-EGF7 protein | PRT648 |
| SEQ ID NO: 649 | human Latent-transforming growth factor beta-binding protein 1-EGF8 protein | PRT649 |
| SEQ ID NO: 650 | human Latent-transforming growth factor beta-binding protein 1-EGF9 protein | PRT650 |
| SEQ ID NO: 651 | human Latent-transforming growth factor beta-binding protein 2-EGF1 protein | PRT651 |
| SEQ ID NO: 652 | human Latent-transforming growth factor beta-binding protein 2-EGF10 protein | PRT652 |
| SEQ ID NO: 653 | human Latent-transforming growth factor beta-binding protein 2-EGF11 protein | PRT653 |
| SEQ ID NO: 654 | human Latent-transforming growth factor beta-binding protein 2-EGF12 protein | PRT654 |
| SEQ ID NO: 655 | human Latent-transforming growth factor beta-binding protein 2-EGF13 protein | PRT655 |
| SEQ ID NO: 656 | human Latent-transforming growth factor beta-binding protein 2-EGF14 protein | PRT656 |
| SEQ ID NO: 657 | human Latent-transforming growth factor beta-binding protein 2-EGF15 protein | PRT657 |
| SEQ ID NO: 658 | human Latent-transforming growth factor beta-binding protein 2-EGF16 protein | PRT658 |
| SEQ ID NO: 659 | human Latent-transforming growth factor beta-binding protein 2-EGF17 protein | PRT659 |
| SEQ ID NO: 660 | human Latent-transforming growth factor beta-binding protein 2-EGF18 protein | PRT660 |
| SEQ ID NO: 661 | human Latent-transforming growth factor beta-binding protein 2-EGF19 protein | PRT661 |
| SEQ ID NO: 662 | human Latent-transforming growth factor beta-binding protein 2-EGF2 protein | PRT662 |
| SEQ ID NO: 663 | human Latent-transforming growth factor beta-binding protein 2-EGF20 protein | PRT663 |
| SEQ ID NO: 664 | human Latent-transforming growth factor beta-binding protein 2-EGF3 protein | PRT664 |
| SEQ ID NO: 665 | human Latent-transforming growth factor beta-binding protein 2-EGF4 protein | PRT665 |
| SEQ ID NO: 666 | human Latent-transforming growth factor beta-binding protein 2-EGF5 protein | PRT666 |
| SEQ ID NO: 667 | human Latent-transforming growth factor beta-binding protein 2-EGF6 protein | PRT667 |
| SEQ ID NO: 668 | human Latent-transforming growth factor beta-binding protein 2-EGF7 protein | PRT668 |
| SEQ ID NO: 669 | human Latent-transforming growth factor beta-binding protein 2-EGF8 protein | PRT669 |

TABLE 1-continued

Designation of the human-originated EGF domain proteins set forth in the present invention

| No. in the sequence listing | Designation | Code in the invention |
|---|---|---|
| SEQ ID NO: 670 | human Latent-transforming growth factor beta-binding protein 2-EGF9 protein | PRT670 |
| SEQ ID NO: 671 | human Latent-transforming growth factor beta-binding protein 3-EGF1 protein | PRT671 |
| SEQ ID NO: 672 | human Latent-transforming growth factor beta-binding protein 3-EGF10 protein | PRT672 |
| SEQ ID NO: 673 | human Latent-transforming growth factor beta-binding protein 3-EGF11 protein | PRT673 |
| SEQ ID NO: 674 | human Latent-transforming growth factor beta-binding protein 3-EGF12 protein | PRT674 |
| SEQ ID NO: 675 | human Latent-transforming growth factor beta-binding protein 3-EGF13 protein | PRT675 |
| SEQ ID NO: 676 | human Latent-transforming growth factor beta-binding protein 3-EGF2 protein | PRT676 |
| SEQ ID NO: 677 | human Latent-transforming growth factor beta-binding protein 3-EGF3 protein | PRT677 |
| SEQ ID NO: 678 | human Latent-transforming growth factor beta-binding protein 3-EGF4 protein | PRT678 |
| SEQ ID NO: 679 | human Latent-transforming growth factor beta-binding protein 3-EGF5 protein | PRT679 |
| SEQ ID NO: 680 | human Latent-transforming growth factor beta-binding protein 3-EGF6 protein | PRT680 |
| SEQ ID NO: 681 | human Latent-transforming growth factor beta-binding protein 3-EGF7 protein | PRT681 |
| SEQ ID NO: 682 | human Latent-transforming growth factor beta-binding protein 3-EGF8 protein | PRT682 |
| SEQ ID NO: 683 | human Latent-transforming growth factor beta-binding protein 3-EGF9 protein | PRT683 |
| SEQ ID NO: 684 | human Latent-transforming growth factor beta-binding protein 4-EGF1 protein | PRT684 |
| SEQ ID NO: 685 | human Latent-transforming growth factor beta-binding protein 4-EGF10 protein | PRT685 |
| SEQ ID NO: 686 | human Latent-transforming growth factor beta-binding protein 4-EGF11 protein | PRT686 |
| SEQ ID NO: 687 | human Latent-transforming growth factor beta-binding protein 4-EGF12 protein | PRT687 |
| SEQ ID NO: 688 | human Latent-transforming growth factor beta-binding protein 4-EGF13 protein | PRT688 |
| SEQ ID NO: 689 | human Latent-transforming growth factor beta-binding protein 4-EGF14 protein | PRT689 |
| SEQ ID NO: 690 | human Latent-transforming growth factor beta-binding protein 4-EGF15 protein | PRT690 |
| SEQ ID NO: 691 | human Latent-transforming growth factor beta-binding protein 4-EGF16 protein | PRT691 |
| SEQ ID NO: 692 | human Latent-transforming growth factor beta-binding protein 4-EGF2 protein | PRT692 |
| SEQ ID NO: 693 | human Latent-transforming growth factor beta-binding protein 4-EGF3 protein | PRT693 |
| SEQ ID NO: 694 | human Latent-transforming growth factor beta-binding protein 4-EGF4 protein | PRT694 |
| SEQ ID NO: 695 | human Latent-transforming growth factor beta-binding protein 4-EGF5 protein | PRT695 |
| SEQ ID NO: 696 | human Latent-transforming growth factor beta-binding protein 4-EGF6 protein | PRT696 |
| SEQ ID NO: 697 | human Latent-transforming growth factor beta-binding protein 4-EGF7 protein | PRT697 |
| SEQ ID NO: 698 | human Latent-transforming growth factor beta-binding protein 4-EGF8 protein | PRT698 |
| SEQ ID NO: 699 | human Latent-transforming growth factor beta-binding protein 4-EGF9 protein | PRT699 |
| SEQ ID NO: 700 | human Low-density lipoprotein receptor-EGF1 protein | PRT700 |
| SEQ ID NO: 701 | human Low-density lipoprotein receptor-EGF2 protein | PRT701 |
| SEQ ID NO: 702 | human Low-density lipoprotein receptor-EGF3 protein | PRT702 |
| SEQ ID NO: 703 | human Low-density lipoprotein receptor-related protein 1-EGF1 protein | PRT703 |
| SEQ ID NO: 704 | human Low-density lipoprotein receptor-related protein 1B-EGF1 protein | PRT704 |
| SEQ ID NO: 705 | human Low-density lipoprotein receptor-related protein 1B-EGF10 protein | PRT705 |
| SEQ ID NO: 706 | human Low-density lipoprotein receptor-related protein 1B-EGF11 protein | PRT706 |
| SEQ ID NO: 707 | human Low-density lipoprotein receptor-related protein 1B-EGF12 protein | PRT707 |
| SEQ ID NO: 708 | human Low-density lipoprotein receptor-related protein 1B-EGF13 protein | PRT708 |

TABLE 1-continued

Designation of the human-originated EGF domain proteins set forth in the present invention

| No. in the sequence listing | Designation | Code in the invention |
|---|---|---|
| SEQ ID NO: 709 | human Low-density lipoprotein receptor-related protein 1B-EGF14 protein | PRT709 |
| SEQ ID NO: 710 | human Low-density lipoprotein receptor-related protein 1B-EGF2 protein | PRT710 |
| SEQ ID NO: 711 | human Low-density lipoprotein receptor-related protein 1B-EGF3 protein | PRT711 |
| SEQ ID NO: 712 | human Low-density lipoprotein receptor-related protein 1B-EGF4 protein | PRT712 |
| SEQ ID NO: 713 | human Low-density lipoprotein receptor-related protein 1B-EGF5 protein | PRT713 |
| SEQ ID NO: 714 | human Low-density lipoprotein receptor-related protein 1B-EGF6 protein | PRT714 |
| SEQ ID NO: 715 | human Low-density lipoprotein receptor-related protein 1B-EGF7 protein | PRT715 |
| SEQ ID NO: 716 | human Low-density lipoprotein receptor-related protein 1B-EGF8 protein | PRT716 |
| SEQ ID NO: 717 | human Low-density lipoprotein receptor-related protein 1B-EGF9 protein | PRT717 |
| SEQ ID NO: 718 | human Low-density lipoprotein receptor-related protein 2-EGF1 protein | PRT718 |
| SEQ ID NO: 719 | human Low-density lipoprotein receptor-related protein 2-EGF10 protein | PRT719 |
| SEQ ID NO: 720 | human Low-density lipoprotein receptor-related protein 2-EGF11 protein | PRT720 |
| SEQ ID NO: 721 | human Low-density lipoprotein receptor-related protein 2-EGF12 protein | PRT721 |
| SEQ ID NO: 722 | human Low-density lipoprotein receptor-related protein 2-EGF13 protein | PRT722 |
| SEQ ID NO: 723 | human Low-density lipoprotein receptor-related protein 2-EGF14 protein | PRT723 |
| SEQ ID NO: 724 | human Low-density lipoprotein receptor-related protein 2-EGF15 protein | PRT724 |
| SEQ ID NO: 725 | human Low-density lipoprotein receptor-related protein 2-EGF16 protein | PRT725 |
| SEQ ID NO: 726 | human Low-density lipoprotein receptor-related protein 2-EGF17 protein | PRT726 |
| SEQ ID NO: 727 | human Low-density lipoprotein receptor-related protein 2-EGF2 protein | PRT727 |
| SEQ ID NO: 728 | human Low-density lipoprotein receptor-related protein 2-EGF3 protein | PRT728 |
| SEQ ID NO: 729 | human Low-density lipoprotein receptor-related protein 2-EGF4 protein | PRT729 |
| SEQ ID NO: 730 | human Low-density lipoprotein receptor-related protein 2-EGF5 protein | PRT730 |
| SEQ ID NO: 731 | human Low-density lipoprotein receptor-related protein 2-EGF6 protein | PRT731 |
| SEQ ID NO: 732 | human Low-density lipoprotein receptor-related protein 2-EGF7 protein | PRT732 |
| SEQ ID NO: 733 | human Low-density lipoprotein receptor-related protein 2-EGF8 protein | PRT733 |
| SEQ ID NO: 734 | human Low-density lipoprotein receptor-related protein 2-EGF9 protein | PRT734 |
| SEQ ID NO: 735 | human Low-density lipoprotein receptor-related protein 4-EGF1 protein | PRT735 |
| SEQ ID NO: 736 | human Low-density lipoprotein receptor-related protein 4-EGF2 protein | PRT736 |
| SEQ ID NO: 737 | human Low-density lipoprotein receptor-related protein 4-EGF3 protein | PRT737 |
| SEQ ID NO: 738 | human Low-density lipoprotein receptor-related protein 5-EGF1 protein | PRT738 |
| SEQ ID NO: 739 | human Low-density lipoprotein receptor-related protein 5-EGF2 protein | PRT739 |
| SEQ ID NO: 740 | human Low-density lipoprotein receptor-related protein 5-EGF3 protein | PRT740 |
| SEQ ID NO: 741 | human Low-density lipoprotein receptor-related protein 5-EGF4 protein | PRT741 |
| SEQ ID NO: 742 | human Low-density lipoprotein receptor-related protein 6-EGF1 protein | PRT742 |
| SEQ ID NO: 743 | human Low-density lipoprotein receptor-related protein 6-EGF2 protein | PRT743 |
| SEQ ID NO: 744 | human Low-density lipoprotein receptor-related protein 6-EGF3 protein | PRT744 |
| SEQ ID NO: 745 | human Low-density lipoprotein receptor-related protein 6-EGF4 protein | PRT745 |

TABLE 1-continued

Designation of the human-originated EGF domain proteins set forth in the present invention

| No. in the sequence listing | Designation | Code in the invention |
|---|---|---|
| SEQ ID NO: 746 | human Low-density lipoprotein receptor-related protein 8-EGF1 protein | PRT746 |
| SEQ ID NO: 747 | human Low-density lipoprotein receptor-related protein 8-EGF2 protein | PRT747 |
| SEQ ID NO: 748 | human L-selectin-EGF1 protein | PRT748 |
| SEQ ID NO: 749 | human Mannan-binding lectin serine protease 1-EGF1 protein | PRT749 |
| SEQ ID NO: 750 | human Mannan-binding lectin serine protease 2-EGF1 protein | PRT750 |
| SEQ ID NO: 751 | human MATN1 protein-EGF1 protein | PRT751 |
| SEQ ID NO: 752 | human Matrilin-2-EGF1 protein | PRT752 |
| SEQ ID NO: 753 | human Matrilin-2-EGF10 protein | PRT753 |
| SEQ ID NO: 754 | human Matrilin-2-EGF2 protein | PRT754 |
| SEQ ID NO: 755 | human Matrilin-2-EGF3 protein | PRT755 |
| SEQ ID NO: 756 | human Matrilin-2-EGF4 protein | PRT756 |
| SEQ ID NO: 757 | human Matrilin-2-EGF5 protein | PRT757 |
| SEQ ID NO: 758 | human Matrilin-2-EGF6 protein | PRT758 |
| SEQ ID NO: 759 | human Matrilin-2-EGF7 protein | PRT759 |
| SEQ ID NO: 760 | human Matrilin-2-EGF8 protein | PRT760 |
| SEQ ID NO: 761 | human Matrilin-2-EGF9 protein | PRT761 |
| SEQ ID NO: 762 | human Matrilin-3-EGF1 protein | PRT762 |
| SEQ ID NO: 763 | human Matrilin-3-EGF2 protein | PRT763 |
| SEQ ID NO: 764 | human Matrilin-3-EGF3 protein | PRT764 |
| SEQ ID NO: 765 | human Matrilin-3-EGF4 protein | PRT765 |
| SEQ ID NO: 766 | human Matrilin-4-EGF1 protein | PRT766 |
| SEQ ID NO: 767 | human Matrilin-4-EGF2 protein | PRT767 |
| SEQ ID NO: 768 | human Matrilin-4-EGF3 protein | PRT768 |
| SEQ ID NO: 769 | human Matrilin-4-EGF4 protein | PRT769 |
| SEQ ID NO: 770 | human Meprin A subunit alpha-EGF1 protein | PRT770 |
| SEQ ID NO: 771 | human Meprin A subunit beta-EGF1 protein | PRT771 |
| SEQ ID NO: 772 | human Mucin-12-EGF1 protein | PRT772 |
| SEQ ID NO: 773 | human Mucin-13-EGF1 protein | PRT773 |
| SEQ ID NO: 774 | human Mucin-13-EGF2 protein | PRT774 |
| SEQ ID NO: 775 | human Mucin-13-EGF3 protein | PRT775 |
| SEQ ID NO: 776 | human Mucin-17-EGF1 protein | PRT776 |
| SEQ ID NO: 777 | human Mucin-3A-EGF1 protein | PRT777 |
| SEQ ID NO: 778 | human Mucin-4-EGF1 protein | PRT778 |
| SEQ ID NO: 779 | human Mucin-4-EGF2 protein | PRT779 |
| SEQ ID NO: 780 | human Multimerin-1-EGF1 protein | PRT780 |
| SEQ ID NO: 781 | human Multiple epidermal growth factor-like domains protein 10-EGF1 protein | PRT781 |
| SEQ ID NO: 782 | human Multiple epidermal growth factor-like domains protein 10-EGF10 protein | PRT782 |
| SEQ ID NO: 783 | human Multiple epidermal growth factor-like domains protein 10-EGF11 protein | PRT783 |
| SEQ ID NO: 784 | human Multiple epidermal growth factor-like domains protein 10-EGF12 protein | PRT784 |
| SEQ ID NO: 785 | human Multiple epidermal growth factor-like domains protein 10-EGF13 protein | PRT785 |
| SEQ ID NO: 786 | human Multiple epidermal growth factor-like domains protein 10-EGF14 protein | PRT786 |
| SEQ ID NO: 787 | human Multiple epidermal growth factor-like domains protein 10-EGF15 protein | PRT787 |
| SEQ ID NO: 788 | human Multiple epidermal growth factor-like domains protein 10-EGF2 protein | PRT788 |
| SEQ ID NO: 789 | human Multiple epidermal growth factor-like domains protein 10-EGF3 protein | PRT789 |
| SEQ ID NO: 790 | human Multiple epidermal growth factor-like domains protein 10-EGF4 protein | PRT790 |
| SEQ ID NO: 791 | human Multiple epidermal growth factor-like domains protein 10-EGF5 protein | PRT791 |
| SEQ ID NO: 792 | human Multiple epidermal growth factor-like domains protein 10-EGF6 protein | PRT792 |
| SEQ ID NO: 793 | human Multiple epidermal growth factor-like domains protein 10-EGF7 protein | PRT793 |
| SEQ ID NO: 794 | human Multiple epidermal growth factor-like domains protein 10-EGF8 protein | PRT794 |
| SEQ ID NO: 795 | human Multiple epidermal growth factor-like domains protein 10-EGF9 protein | PRT795 |
| SEQ ID NO: 796 | human Multiple epidermal growth factor-like domains protein 11-EGF1 protein | PRT796 |
| SEQ ID NO: 797 | human Multiple epidermal growth factor-like domains protein 11-EGF10 protein | PRT797 |
| SEQ ID NO: 798 | human Multiple epidermal growth factor-like domains protein 11-EGF11 protein | PRT798 |
| SEQ ID NO: 799 | human Multiple epidermal growth factor-like domains protein 11-EGF12 protein | PRT799 |

TABLE 1-continued

Designation of the human-originated EGF domain proteins set forth in the present invention

| No. in the sequence listing | Designation | Code in the invention |
|---|---|---|
| SEQ ID NO: 800 | human Multiple epidermal growth factor-like domains protein 11-EGF13 protein | PRT800 |
| SEQ ID NO: 801 | human Multiple epidermal growth factor-like domains protein 11-EGF14 protein | PRT801 |
| SEQ ID NO: 802 | human Multiple epidermal growth factor-like domains protein 11-EGF2 protein | PRT802 |
| SEQ ID NO: 803 | human Multiple epidermal growth factor-like domains protein 11-EGF3 protein | PRT803 |
| SEQ ID NO: 804 | human Multiple epidermal growth factor-like domains protein 11-EGF4 protein | PRT804 |
| SEQ ID NO: 805 | human Multiple epidermal growth factor-like domains protein 11-EGF5 protein | PRT805 |
| SEQ ID NO: 806 | human Multiple epidermal growth factor-like domains protein 11-EGF6 protein | PRT806 |
| SEQ ID NO: 807 | human Multiple epidermal growth factor-like domains protein 11-EGF7 protein | PRT807 |
| SEQ ID NO: 808 | human Multiple epidermal growth factor-like domains protein 11-EGF8 protein | PRT808 |
| SEQ ID NO: 809 | human Multiple epidermal growth factor-like domains protein 11-EGF9 protein | PRT809 |
| SEQ ID NO: 810 | human Multiple epidermal growth factor-like domains protein 6-EGF1 protein | PRT810 |
| SEQ ID NO: 811 | human Multiple epidermal growth factor-like domains protein 6-EGF10 protein | PRT811 |
| SEQ ID NO: 812 | human Multiple epidermal growth factor-like domains protein 6-EGF11 protein | PRT812 |
| SEQ ID NO: 813 | human Multiple epidermal growth factor-like domains protein 6-EGF12 protein | PRT813 |
| SEQ ID NO: 814 | human Multiple epidermal growth factor-like domains protein 6-EGF13 protein | PRT814 |
| SEQ ID NO: 815 | human Multiple epidermal growth factor-like domains protein 6-EGF14 protein | PRT815 |
| SEQ ID NO: 816 | human Multiple epidermal growth factor-like domains protein 6-EGF15 protein | PRT816 |
| SEQ ID NO: 817 | human Multiple epidermal growth factor-like domains protein 6-EGF16 protein | PRT817 |
| SEQ ID NO: 818 | human Multiple epidermal growth factor-like domains protein 6-EGF17 protein | PRT818 |
| SEQ ID NO: 819 | human Multiple epidermal growth factor-like domains protein 6-EGF18 protein | PRT819 |
| SEQ ID NO: 820 | human Multiple epidermal growth factor-like domains protein 6-EGF19 protein | PRT820 |
| SEQ ID NO: 821 | human Multiple epidermal growth factor-like domains protein 6-EGF2 protein | PRT821 |
| SEQ ID NO: 822 | human Multiple epidermal growth factor-like domains protein 6-EGF20 protein | PRT822 |
| SEQ ID NO: 823 | human Multiple epidermal growth factor-like domains protein 6-EGF21 protein | PRT823 |
| SEQ ID NO: 824 | human Multiple epidermal growth factor-like domains protein 6-EGF22 protein | PRT824 |
| SEQ ID NO: 825 | human Multiple epidermal growth factor-like domains protein 6-EGF23 protein | PRT825 |
| SEQ ID NO: 826 | human Multiple epidermal growth factor-like domains protein 6-EGF24 protein | PRT826 |
| SEQ ID NO: 827 | human Multiple epidermal growth factor-like domains protein 6-EGF25 protein | PRT827 |
| SEQ ID NO: 828 | human Multiple epidermal growth factor-like domains protein 6-EGF26 protein | PRT828 |
| SEQ ID NO: 829 | human Multiple epidermal growth factor-like domains protein 6-EGF27 protein | PRT829 |
| SEQ ID NO: 830 | human Multiple epidermal growth factor-like domains protein 6-EGF3 protein | PRT830 |
| SEQ ID NO: 831 | human Multiple epidermal growth factor-like domains protein 6-EGF4 protein | PRT831 |
| SEQ ID NO: 832 | human Multiple epidermal growth factor-like domains protein 6-EGF5 protein | PRT832 |
| SEQ ID NO: 833 | human Multiple epidermal growth factor-like domains protein 6-EGF6 protein | PRT833 |
| SEQ ID NO: 834 | human Multiple epidermal growth factor-like domains protein 6-EGF7 protein | PRT834 |
| SEQ ID NO: 835 | human Multiple epidermal growth factor-like domains protein 6-EGF8 protein | PRT835 |
| SEQ ID NO: 836 | human Multiple epidermal growth factor-like domains protein 6-EGF9 protein | PRT836 |

TABLE 1-continued

Designation of the human-originated EGF domain proteins set forth in the present invention

| No. in the sequence listing | Designation | Code in the invention |
|---|---|---|
| SEQ ID NO: 837 | human Multiple epidermal growth factor-like domains protein 8-EGF1 protein | PRT837 |
| SEQ ID NO: 838 | human Multiple epidermal growth factor-like domains protein 8-EGF2 protein | PRT838 |
| SEQ ID NO: 839 | human Multiple epidermal growth factor-like domains protein 8-EGF3 protein | PRT839 |
| SEQ ID NO: 840 | human Multiple epidermal growth factor-like domains protein 8-EGF4 protein | PRT840 |
| SEQ ID NO: 841 | human Multiple epidermal growth factor-like domains protein 8-EGF5 protein | PRT841 |
| SEQ ID NO: 842 | human Multiple epidermal growth factor-like domains protein 8-EGF6 protein | PRT842 |
| SEQ ID NO: 843 | human Multiple epidermal growth factor-like domains protein 8-EGF7 protein | PRT843 |
| SEQ ID NO: 844 | human Multiple epidermal growth factor-like domains protein 8-EGF8 protein | PRT844 |
| SEQ ID NO: 845 | human Multiple epidermal growth factor-like domains protein 8-EGF9 protein | PRT845 |
| SEQ ID NO: 846 | human Multiple epidermal growth factor-like domains protein 9-EGF1 protein | PRT846 |
| SEQ ID NO: 847 | human Multiple epidermal growth factor-like domains protein 9-EGF2 protein | PRT847 |
| SEQ ID NO: 848 | human Multiple epidermal growth factor-like domains protein 9-EGF3 protein | PRT848 |
| SEQ ID NO: 849 | human Multiple epidermal growth factor-like domains protein 9-EGF4 protein | PRT849 |
| SEQ ID NO: 850 | human Multiple epidermal growth factor-like domains protein 9-EGF5 protein | PRT850 |
| SEQ ID NO: 851 | human N-acetylglucosamine-1-phosphodiester alpha-N-acetylglucosaminidase-EGF1 protein | PRT851 |
| SEQ ID NO: 852 | human Nephronectin-EGF1 protein | PRT852 |
| SEQ ID NO: 853 | human Nephronectin-EGF2 protein | PRT853 |
| SEQ ID NO: 854 | human Nephronectin-EGF3 protein | PRT854 |
| SEQ ID NO: 855 | human Nephronectin-EGF4 protein | PRT855 |
| SEQ ID NO: 856 | human Nephronectin-EGF5 protein | PRT856 |
| SEQ ID NO: 857 | human Netrin-1-EGF1 protein | PRT857 |
| SEQ ID NO: 858 | human Netrin-1-EGF2 protein | PRT858 |
| SEQ ID NO: 859 | human Netrin-1-EGF3 protein | PRT859 |
| SEQ ID NO: 860 | human Netrin-3-EGF1 protein | PRT860 |
| SEQ ID NO: 861 | human Netrin-3-EGF2 protein | PRT861 |
| SEQ ID NO: 862 | human Netrin-3-EGF3 protein | PRT862 |
| SEQ ID NO: 863 | human Netrin-4-EGF1 protein | PRT863 |
| SEQ ID NO: 864 | human Netrin-4-EGF2 protein | PRT864 |
| SEQ ID NO: 865 | human Netrin-4-EGF3 protein | PRT865 |
| SEQ ID NO: 866 | human Netrin-5-EGF1 protein | PRT866 |
| SEQ ID NO: 867 | human Netrin-5-EGF2 protein | PRT867 |
| SEQ ID NO: 868 | human Netrin-5-EGF3 protein | PRT868 |
| SEQ ID NO: 869 | human Netrin-G1-EGF1 protein | PRT869 |
| SEQ ID NO: 870 | human Netrin-G1-EGF2 protein | PRT870 |
| SEQ ID NO: 871 | human Netrin-G1-EGF3 protein | PRT871 |
| SEQ ID NO: 872 | human Netrin-G2-EGF1 protein | PRT872 |
| SEQ ID NO: 873 | human Netrin-G2-EGF2 protein | PRT873 |
| SEQ ID NO: 874 | human Netrin-G2-EGF3 protein | PRT874 |
| SEQ ID NO: 875 | human Neurexin-1-EGF1 protein | PRT875 |
| SEQ ID NO: 876 | human Neurexin-1-EGF2 protein | PRT876 |
| SEQ ID NO: 877 | human Neurexin-1-EGF3 protein | PRT877 |
| SEQ ID NO: 878 | human Neurexin-2-EGF1 protein | PRT878 |
| SEQ ID NO: 879 | human Neurexin-2-EGF2 protein | PRT879 |
| SEQ ID NO: 880 | human Neurexin-2-EGF3 protein | PRT880 |
| SEQ ID NO: 881 | human Neurexin-3-EGF1 protein | PRT881 |
| SEQ ID NO: 882 | human Neurexin-3-EGF2 protein | PRT882 |
| SEQ ID NO: 883 | human Neurexin-3-EGF3 protein | PRT883 |
| SEQ ID NO: 884 | human Neurocan core protein-EGF1 protein | PRT884 |
| SEQ ID NO: 885 | human Neurocan core protein-EGF2 protein | PRT885 |
| SEQ ID NO: 886 | human Neurogenic locus notch homolog protein 1-EGF1 protein | PRT886 |
| SEQ ID NO: 887 | human Neurogenic locus notch homolog protein 1-EGF10 protein | PRT887 |
| SEQ ID NO: 888 | human Neurogenic locus notch homolog protein 1-EGF11 protein | PRT888 |
| SEQ ID NO: 889 | human Neurogenic locus notch homolog protein 1-EGF12 protein | PRT889 |
| SEQ ID NO: 890 | human Neurogenic locus notch homolog protein 1-EGF13 protein | PRT890 |
| SEQ ID NO: 891 | human Neurogenic locus notch homolog protein 1-EGF14 protein | PRT891 |
| SEQ ID NO: 892 | human Neurogenic locus notch homolog protein 1-EGF15 protein | PRT892 |
| SEQ ID NO: 893 | human Neurogenic locus notch homolog protein 1-EGF16 protein | PRT893 |
| SEQ ID NO: 894 | human Neurogenic locus notch homolog protein 1-EGF17 protein | PRT894 |
| SEQ ID NO: 895 | human Neurogenic locus notch homolog protein 1-EGF18 protein | PRT895 |
| SEQ ID NO: 896 | human Neurogenic locus notch homolog protein 1-EGF19 protein | PRT896 |

TABLE 1-continued

Designation of the human-originated EGF domain proteins set forth in the present invention

| No. in the sequence listing | Designation | Code in the invention |
|---|---|---|
| SEQ ID NO: 897 | human Neurogenic locus notch homolog protein 1-EGF2 protein | PRT897 |
| SEQ ID NO: 898 | human Neurogenic locus notch homolog protein 1-EGF20 protein | PRT898 |
| SEQ ID NO: 899 | human Neurogenic locus notch homolog protein 1-EGF21 protein | PRT899 |
| SEQ ID NO: 900 | human Neurogenic locus notch homolog protein 1-EGF22 protein | PRT900 |
| SEQ ID NO: 901 | human Neurogenic locus notch homolog protein 1-EGF23 protein | PRT901 |
| SEQ ID NO: 902 | human Neurogenic locus notch homolog protein 1-EGF24 protein | PRT902 |
| SEQ ID NO: 903 | human Neurogenic locus notch homolog protein 1-EGF25 protein | PRT903 |
| SEQ ID NO: 904 | human Neurogenic locus notch homolog protein 1-EGF26 protein | PRT904 |
| SEQ ID NO: 905 | human Neurogenic locus notch homolog protein 1-EGF27 protein | PRT905 |
| SEQ ID NO: 906 | human Neurogenic locus notch homolog protein 1-EGF28 protein | PRT906 |
| SEQ ID NO: 907 | human Neurogenic locus notch homolog protein 1-EGF29 protein | PRT907 |
| SEQ ID NO: 908 | human Neurogenic locus notch homolog protein 1-EGF3 protein | PRT908 |
| SEQ ID NO: 909 | human Neurogenic locus notch homolog protein 1-EGF30 protein | PRT909 |
| SEQ ID NO: 910 | human Neurogenic locus notch homolog protein 1-EGF31 protein | PRT910 |
| SEQ ID NO: 911 | human Neurogenic locus notch homolog protein 1-EGF32 protein | PRT911 |
| SEQ ID NO: 912 | human Neurogenic locus notch homolog protein 1-EGF33 protein | PRT912 |
| SEQ ID NO: 913 | human Neurogenic locus notch homolog protein 1-EGF34 protein | PRT913 |
| SEQ ID NO: 914 | human Neurogenic locus notch homolog protein 1-EGF35 protein | PRT914 |
| SEQ ID NO: 915 | human Neurogenic locus notch homolog protein 1-EGF36 protein | PRT915 |
| SEQ ID NO: 916 | human Neurogenic locus notch homolog protein 1-EGF4 protein | PRT916 |
| SEQ ID NO: 917 | human Neurogenic locus notch homolog protein 1-EGF5 protein | PRT917 |
| SEQ ID NO: 918 | human Neurogenic locus notch homolog protein 1-EGF6 protein | PRT918 |
| SEQ ID NO: 919 | human Neurogenic locus notch homolog protein 1-EGF7 protein | PRT919 |
| SEQ ID NO: 920 | human Neurogenic locus notch homolog protein 1-EGF8 protein | PRT920 |
| SEQ ID NO: 921 | human Neurogenic locus notch homolog protein 1-EGF9 protein | PRT921 |
| SEQ ID NO: 922 | human Neurogenic locus notch homolog protein 2-EGF1 protein | PRT922 |
| SEQ ID NO: 923 | human Neurogenic locus notch homolog protein 2-EGF10 protein | PRT923 |
| SEQ ID NO: 924 | human Neurogenic locus notch homolog protein 2-EGF11 protein | PRT924 |
| SEQ ID NO: 925 | human Neurogenic locus notch homolog protein 2-EGF12 protein | PRT925 |
| SEQ ID NO: 926 | human Neurogenic locus notch homolog protein 2-EGF13 protein | PRT926 |
| SEQ ID NO: 927 | human Neurogenic locus notch homolog protein 2-EGF14 protein | PRT927 |
| SEQ ID NO: 928 | human Neurogenic locus notch homolog protein 2-EGF15 protein | PRT928 |
| SEQ ID NO: 929 | human Neurogenic locus notch homolog protein 2-EGF16 protein | PRT929 |
| SEQ ID NO: 930 | human Neurogenic locus notch homolog protein 2-EGF17 protein | PRT930 |
| SEQ ID NO: 931 | human Neurogenic locus notch homolog protein 2-EGF18 protein | PRT931 |
| SEQ ID NO: 932 | human Neurogenic locus notch homolog protein 2-EGF19 protein | PRT932 |
| SEQ ID NO: 933 | human Neurogenic locus notch homolog protein 2-EGF2 protein | PRT933 |
| SEQ ID NO: 934 | human Neurogenic locus notch homolog protein 2-EGF20 protein | PRT934 |
| SEQ ID NO: 935 | human Neurogenic locus notch homolog protein 2-EGF21 protein | PRT935 |
| SEQ ID NO: 936 | human Neurogenic locus notch homolog protein 2-EGF22 protein | PRT936 |
| SEQ ID NO: 937 | human Neurogenic locus notch homolog protein 2-EGF23 protein | PRT937 |
| SEQ ID NO: 938 | human Neurogenic locus notch homolog protein 2-EGF24 protein | PRT938 |
| SEQ ID NO: 939 | human Neurogenic locus notch homolog protein 2-EGF25 protein | PRT939 |
| SEQ ID NO: 940 | human Neurogenic locus notch homolog protein 2-EGF26 protein | PRT940 |
| SEQ ID NO: 941 | human Neurogenic locus notch homolog protein 2-EGF27 protein | PRT941 |
| SEQ ID NO: 942 | human Neurogenic locus notch homolog protein 2-EGF28 protein | PRT942 |
| SEQ ID NO: 943 | human Neurogenic locus notch homolog protein 2-EGF29 protein | PRT943 |
| SEQ ID NO: 944 | human Neurogenic locus notch homolog protein 2-EGF3 protein | PRT944 |
| SEQ ID NO: 945 | human Neurogenic locus notch homolog protein 2-EGF30 protein | PRT945 |
| SEQ ID NO: 946 | human Neurogenic locus notch homolog protein 2-EGF31 protein | PRT946 |
| SEQ ID NO: 947 | human Neurogenic locus notch homolog protein 2-EGF32 protein | PRT947 |
| SEQ ID NO: 948 | human Neurogenic locus notch homolog protein 2-EGF33 protein | PRT948 |
| SEQ ID NO: 949 | human Neurogenic locus notch homolog protein 2-EGF34 protein | PRT949 |
| SEQ ID NO: 950 | human Neurogenic locus notch homolog protein 2-EGF35 protein | PRT950 |
| SEQ ID NO: 951 | human Neurogenic locus notch homolog protein 2-EGF4 protein | PRT951 |
| SEQ ID NO: 952 | human Neurogenic locus notch homolog protein 2-EGF5 protein | PRT952 |
| SEQ ID NO: 953 | human Neurogenic locus notch homolog protein 2-EGF6 protein | PRT953 |
| SEQ ID NO: 954 | human Neurogenic locus notch homolog protein 2-EGF7 protein | PRT954 |
| SEQ ID NO: 955 | human Neurogenic locus notch homolog protein 2-EGF8 protein | PRT955 |
| SEQ ID NO: 956 | human Neurogenic locus notch homolog protein 2-EGF9 protein | PRT956 |
| SEQ ID NO: 957 | human Neurogenic locus notch homolog protein 3-EGF1 protein | PRT957 |
| SEQ ID NO: 958 | human Neurogenic locus notch homolog protein 3-EGF10 protein | PRT958 |
| SEQ ID NO: 959 | human Neurogenic locus notch homolog protein 3-EGF11 protein | PRT959 |
| SEQ ID NO: 960 | human Neurogenic locus notch homolog protein 3-EGF12 protein | PRT960 |
| SEQ ID NO: 961 | human Neurogenic locus notch homolog protein 3-EGF13 protein | PRT961 |
| SEQ ID NO: 962 | human Neurogenic locus notch homolog protein 3-EGF14 protein | PRT962 |
| SEQ ID NO: 963 | human Neurogenic locus notch homolog protein 3-EGF15 protein | PRT963 |
| SEQ ID NO: 964 | human Neurogenic locus notch homolog protein 3-EGF16 protein | PRT964 |
| SEQ ID NO: 965 | human Neurogenic locus notch homolog protein 3-EGF17 protein | PRT965 |
| SEQ ID NO: 966 | human Neurogenic locus notch homolog protein 3-EGF18 protein | PRT966 |
| SEQ ID NO: 967 | human Neurogenic locus notch homolog protein 3-EGF19 protein | PRT967 |
| SEQ ID NO: 968 | human Neurogenic locus notch homolog protein 3-EGF2 protein | PRT968 |
| SEQ ID NO: 969 | human Neurogenic locus notch homolog protein 3-EGF20 protein | PRT969 |
| SEQ ID NO: 970 | human Neurogenic locus notch homolog protein 3-EGF21 protein | PRT970 |
| SEQ ID NO: 971 | human Neurogenic locus notch homolog protein 3-EGF22 protein | PRT971 |

TABLE 1-continued

Designation of the human-originated EGF domain proteins set forth in the present invention

| No. in the sequence listing | Designation | Code in the invention |
|---|---|---|
| SEQ ID NO: 972 | human Neurogenic locus notch homolog protein 3-EGF23 protein | PRT972 |
| SEQ ID NO: 973 | human Neurogenic locus notch homolog protein 3-EGF24 protein | PRT973 |
| SEQ ID NO: 974 | human Neurogenic locus notch homolog protein 3-EGF25 protein | PRT974 |
| SEQ ID NO: 975 | human Neurogenic locus notch homolog protein 3-EGF26 protein | PRT975 |
| SEQ ID NO: 976 | human Neurogenic locus notch homolog protein 3-EGF27 protein | PRT976 |
| SEQ ID NO: 977 | human Neurogenic locus notch homolog protein 3-EGF28 protein | PRT977 |
| SEQ ID NO: 978 | human Neurogenic locus notch homolog protein 3-EGF29 protein | PRT978 |
| SEQ ID NO: 979 | human Neurogenic locus notch homolog protein 3-EGF3 protein | PRT979 |
| SEQ ID NO: 980 | human Neurogenic locus notch homolog protein 3-EGF30 protein | PRT980 |
| SEQ ID NO: 981 | human Neurogenic locus notch homolog protein 3-EGF31 protein | PRT981 |
| SEQ ID NO: 982 | human Neurogenic locus notch homolog protein 3-EGF32 protein | PRT982 |
| SEQ ID NO: 983 | human Neurogenic locus notch homolog protein 3-EGF33 protein | PRT983 |
| SEQ ID NO: 984 | human Neurogenic locus notch homolog protein 3-EGF34 protein | PRT984 |
| SEQ ID NO: 985 | human Neurogenic locus notch homolog protein 3-EGF4 protein | PRT985 |
| SEQ ID NO: 986 | human Neurogenic locus notch homolog protein 3-EGF5 protein | PRT986 |
| SEQ ID NO: 987 | human Neurogenic locus notch homolog protein 3-EGF6 protein | PRT987 |
| SEQ ID NO: 988 | human Neurogenic locus notch homolog protein 3-EGF7 protein | PRT988 |
| SEQ ID NO: 989 | human Neurogenic locus notch homolog protein 3-EGF8 protein | PRT989 |
| SEQ ID NO: 990 | human Neurogenic locus notch homolog protein 3-EGF9 protein | PRT990 |
| SEQ ID NO: 991 | human Neurogenic locus notch homolog protein 4-EGF1 protein | PRT991 |
| SEQ ID NO: 992 | human Neurogenic locus notch homolog protein 4-EGF10 protein | PRT992 |
| SEQ ID NO: 993 | human Neurogenic locus notch homolog protein 4-EGF11 protein | PRT993 |
| SEQ ID NO: 994 | human Neurogenic locus notch homolog protein 4-EGF12 protein | PRT994 |
| SEQ ID NO: 995 | human Neurogenic locus notch homolog protein 4-EGF13 protein | PRT995 |
| SEQ ID NO: 996 | human Neurogenic locus notch homolog protein 4-EGF14 protein | PRT996 |
| SEQ ID NO: 997 | human Neurogenic locus notch homolog protein 4-EGF15 protein | PRT997 |
| SEQ ID NO: 998 | human Neurogenic locus notch homolog protein 4-EGF16 protein | PRT998 |
| SEQ ID NO: 999 | human Neurogenic locus notch homolog protein 4-EGF17 protein | PRT999 |
| SEQ ID NO: 1000 | human Neurogenic locus notch homolog protein 4-EGF18 protein | PRT1000 |
| SEQ ID NO: 1001 | human Neurogenic locus notch homolog protein 4-EGF19 protein | PRT1001 |
| SEQ ID NO: 1002 | human Neurogenic locus notch homolog protein 4-EGF2 protein | PRT1002 |
| SEQ ID NO: 1003 | human Neurogenic locus notch homolog protein 4-EGF20 protein | PRT1003 |
| SEQ ID NO: 1004 | human Neurogenic locus notch homolog protein 4-EGF21 protein | PRT1004 |
| SEQ ID NO: 1005 | human Neurogenic locus notch homolog protein 4-EGF22 protein | PRT1005 |
| SEQ ID NO: 1006 | human Neurogenic locus notch homolog protein 4-EGF23 protein | PRT1006 |
| SEQ ID NO: 1007 | human Neurogenic locus notch homolog protein 4-EGF24 protein | PRT1007 |
| SEQ ID NO: 1008 | human Neurogenic locus notch homolog protein 4-EGF25 protein | PRT1008 |
| SEQ ID NO: 1009 | human Neurogenic locus notch homolog protein 4-EGF26 protein | PRT1009 |
| SEQ ID NO: 1010 | human Neurogenic locus notch homolog protein 4-EGF27 protein | PRT1010 |
| SEQ ID NO: 1011 | human Neurogenic locus notch homolog protein 4-EGF28 protein | PRT1011 |
| SEQ ID NO: 1012 | human Neurogenic locus notch homolog protein 4-EGF29 protein | PRT1012 |
| SEQ ID NO: 1013 | human Neurogenic locus notch homolog protein 4-EGF3 protein | PRT1013 |
| SEQ ID NO: 1014 | human Neurogenic locus notch homolog protein 4-EGF4 protein | PRT1014 |
| SEQ ID NO: 1015 | human Neurogenic locus notch homolog protein 4-EGF5 protein | PRT1015 |
| SEQ ID NO: 1016 | human Neurogenic locus notch homolog protein 4-EGF6 protein | PRT1016 |
| SEQ ID NO: 1017 | human Neurogenic locus notch homolog protein 4-EGF7 protein | PRT1017 |
| SEQ ID NO: 1018 | human Neurogenic locus notch homolog protein 4-EGF8 protein | PRT1018 |
| SEQ ID NO: 1019 | human Neurogenic locus notch homolog protein 4-EGF9 protein | PRT1019 |
| SEQ ID NO: 1020 | human Nidogen-1-EGF1 protein | PRT1020 |
| SEQ ID NO: 1021 | human Nidogen-1-EGF2 protein | PRT1021 |
| SEQ ID NO: 1022 | human Nidogen-1-EGF3 protein | PRT1022 |
| SEQ ID NO: 1023 | human Nidogen-1-EGF4 protein | PRT1023 |
| SEQ ID NO: 1024 | human Nidogen-1-EGF5 protein | PRT1024 |
| SEQ ID NO: 1025 | human Nidogen-1-EGF6 protein | PRT1025 |
| SEQ ID NO: 1026 | human Nidogen-2-EGF1 protein | PRT1026 |
| SEQ ID NO: 1027 | human Nidogen-2-EGF2 protein | PRT1027 |
| SEQ ID NO: 1028 | human Nidogen-2-EGF3 protein | PRT1028 |
| SEQ ID NO: 1029 | human Nidogen-2-EGF4 protein | PRT1029 |
| SEQ ID NO: 1030 | human Nidogen-2-EGF5 protein | PRT1030 |
| SEQ ID NO: 1031 | human Notch homolog 2 N-terminal-like protein-EGF1 protein | PRT1031 |
| SEQ ID NO: 1032 | human Notch homolog 2 N-terminal-like protein-EGF2 protein | PRT1032 |
| SEQ ID NO: 1033 | human Notch homolog 2 N-terminal-like protein-EGF3 protein | PRT1033 |
| SEQ ID NO: 1034 | human Oncoprotein-induced transcript 3 protein-EGF1 protein | PRT1034 |
| SEQ ID NO: 1035 | human Otogelin-EGF1 protein | PRT1035 |
| SEQ ID NO: 1036 | human Pancreatic secretory granule membrane major glycoprotein GP2-EGF1 protein | PRT1036 |
| SEQ ID NO: 1037 | human Perforin-1-EGF1 protein | PRT1037 |
| SEQ ID NO: 1038 | human Pikachurin-EGF1 protein | PRT1038 |
| SEQ ID NO: 1039 | human Pikachurin-EGF2 protein | PRT1039 |
| SEQ ID NO: 1040 | human Pikachurin-EGF3 protein | PRT1040 |
| SEQ ID NO: 1041 | human Platelet endothelial aggregation receptor 1-EGF1 protein | PRT1041 |
| SEQ ID NO: 1042 | human Platelet endothelial aggregation receptor 1-EGF2 protein | PRT1042 |
| SEQ ID NO: 1043 | human Platelet endothelial aggregation receptor 1-EGF3 protein | PRT1043 |
| SEQ ID NO: 1044 | human Platelet endothelial aggregation receptor 1-EGF4 protein | PRT1044 |
| SEQ ID NO: 1045 | human Platelet endothelial aggregation receptor 1-EGF5 protein | PRT1045 |

TABLE 1-continued

Designation of the human-originated EGF domain proteins set forth in the present invention

| No. in the sequence listing | Designation | Code in the invention |
|---|---|---|
| SEQ ID NO: 1046 | human Platelet endothelial aggregation receptor 1-EGF6 protein | PRT1046 |
| SEQ ID NO: 1047 | human Platelet endothelial aggregation receptor 1-EGF7 protein | PRT1047 |
| SEQ ID NO: 1048 | human Platelet endothelial aggregation receptor 1-EGF8 protein | PRT1048 |
| SEQ ID NO: 1049 | human Platelet endothelial aggregation receptor 1-EGF9 protein | PRT1049 |
| SEQ ID NO: 1050 | human Probetacellulin-EGF1 protein | PRT1050 |
| SEQ ID NO: 1051 | human Pro-epidermal growth factor-EGF1 protein | PRT1051 |
| SEQ ID NO: 1052 | human Pro-epidermal growth factor-EGF2 protein | PRT1052 |
| SEQ ID NO: 1053 | human Pro-epidermal growth factor-EGF3 protein | PRT1053 |
| SEQ ID NO: 1054 | human Pro-epidermal growth factor-EGF4 protein | PRT1054 |
| SEQ ID NO: 1055 | human Pro-epidermal growth factor-EGF5 protein | PRT1055 |
| SEQ ID NO: 1056 | human Pro-epidermal growth factor-EGF6 protein | PRT1056 |
| SEQ ID NO: 1057 | human Pro-epidermal growth factor-EGF7 protein | PRT1057 |
| SEQ ID NO: 1058 | human Pro-epidermal growth factor-EGF8 protein | PRT1058 |
| SEQ ID NO: 1059 | human Pro-epidermal growth factor-EGF9 protein | PRT1059 |
| SEQ ID NO: 1060 | human Proepiregulin-EGF1 protein | PRT1060 |
| SEQ ID NO: 1061 | human Proheparin-binding EGF-like growth factor-EGF1 protein | PRT1061 |
| SEQ ID NO: 1062 | human Prolow-density lipoprotein receptor-related protein 1-EGF1 protein | PRT1062 |
| SEQ ID NO: 1063 | human Prolow-density lipoprotein receptor-related protein 1-EGF10 protein | PRT1063 |
| SEQ ID NO: 1064 | human Prolow-density lipoprotein receptor-related protein 1-EGF11 protein | PRT1064 |
| SEQ ID NO: 1065 | human Prolow-density lipoprotein receptor-related protein 1-EGF12 protein | PRT1065 |
| SEQ ID NO: 1066 | human Prolow-density lipoprotein receptor-related protein 1-EGF13 protein | PRT1066 |
| SEQ ID NO: 1067 | human Prolow-density lipoprotein receptor-related protein 1-EGF14 protein | PRT1067 |
| SEQ ID NO: 1068 | human Prolow-density lipoprotein receptor-related protein 1-EGF15 protein | PRT1068 |
| SEQ ID NO: 1069 | human Prolow-density lipoprotein receptor-related protein 1-EGF16 protein | PRT1069 |
| SEQ ID NO: 1070 | human Prolow-density lipoprotein receptor-related protein 1-EGF17 protein | PRT1070 |
| SEQ ID NO: 1071 | human Prolow-density lipoprotein receptor-related protein 1-EGF18 protein | PRT1071 |
| SEQ ID NO: 1072 | human Prolow-density lipoprotein receptor-related protein 1-EGF19 protein | PRT1072 |
| SEQ ID NO: 1073 | human Prolow-density lipoprotein receptor-related protein 1-EGF2 protein | PRT1073 |
| SEQ ID NO: 1074 | human Prolow-density lipoprotein receptor-related protein 1-EGF20 protein | PRT1074 |
| SEQ ID NO: 1075 | human Prolow-density lipoprotein receptor-related protein 1-EGF21 protein | PRT1075 |
| SEQ ID NO: 1076 | human Prolow-density lipoprotein receptor-related protein 1-EGF22 protein | PRT1076 |
| SEQ ID NO: 1077 | human Prolow-density lipoprotein receptor-related protein 1-EGF3 protein | PRT1077 |
| SEQ ID NO: 1078 | human Prolow-density lipoprotein receptor-related protein 1-EGF4 protein | PRT1078 |
| SEQ ID NO: 1079 | human Prolow-density lipoprotein receptor-related protein 1-EGF5 protein | PRT1079 |
| SEQ ID NO: 1080 | human Prolow-density lipoprotein receptor-related protein 1-EGF6 protein | PRT1080 |
| SEQ ID NO: 1081 | human Prolow-density lipoprotein receptor-related protein 1-EGF7 protein | PRT1081 |
| SEQ ID NO: 1082 | human Prolow-density lipoprotein receptor-related protein 1-EGF8 protein | PRT1082 |
| SEQ ID NO: 1083 | human Prolow-density lipoprotein receptor-related protein 1-EGF9 protein | PRT1083 |
| SEQ ID NO: 1084 | human Pro-neuregulin-1, membrane-bound isoform-EGF1 protein | PRT1084 |
| SEQ ID NO: 1085 | human Pro-neuregulin-2, membrane-bound isoform-EGF1 protein | PRT1085 |
| SEQ ID NO: 1086 | human Pro-neuregulin-3, membrane-bound isoform-EGF1 protein | PRT1086 |
| SEQ ID NO: 1087 | human Pro-neuregulin-4, membrane-bound isoform-EGF1 protein | PRT1087 |
| SEQ ID NO: 1088 | human Prostaglandin G/H synthase 1-EGF1 protein | PRT1088 |
| SEQ ID NO: 1089 | human Prostaglandin G/H synthase 2-EGF1 protein | PRT1089 |
| SEQ ID NO: 1090 | human Protein crumbs homolog 1-EGF10 protein | PRT1090 |
| SEQ ID NO: 1091 | human Protein crumbs homolog 1-EGF11 protein | PRT1091 |
| SEQ ID NO: 1092 | human Protein crumbs homolog 1-EGF12 protein | PRT1092 |
| SEQ ID NO: 1093 | human Protein crumbs homolog 1-EGF13 protein | PRT1093 |
| SEQ ID NO: 1094 | human Protein crumbs homolog 1-EGF14 protein | PRT1094 |
| SEQ ID NO: 1095 | human Protein crumbs homolog 1-EGF15 protein | PRT1095 |
| SEQ ID NO: 1096 | human Protein crumbs homolog 1-EGF16 protein | PRT1096 |
| SEQ ID NO: 1097 | human Protein crumbs homolog 1-EGF17 protein | PRT1097 |
| SEQ ID NO: 1098 | human Protein crumbs homolog 1-EGF18 protein | PRT1098 |

TABLE 1-continued

Designation of the human-originated EGF domain proteins set forth in the present invention

| No. in the sequence listing | Designation | Code in the invention |
|---|---|---|
| SEQ ID NO: 1099 | human Protein crumbs homolog 1-EGF19 protein | PRT1099 |
| SEQ ID NO: 1100 | human Protein crumbs homolog 1-EGF20 protein | PRT1100 |
| SEQ ID NO: 1101 | human Protein crumbs homolog 1-EGF2 protein | PRT1101 |
| SEQ ID NO: 1102 | human Protein crumbs homolog 1-EGF3 protein | PRT1102 |
| SEQ ID NO: 1103 | human Protein crumbs homolog 1-EGF4 protein | PRT1103 |
| SEQ ID NO: 1104 | human Protein crumbs homolog 1-EGF5 protein | PRT1104 |
| SEQ ID NO: 1105 | human Protein crumbs homolog 1-EGF6 protein | PRT1105 |
| SEQ ID NO: 1106 | human Protein crumbs homolog 1-EGF7 protein | PRT1106 |
| SEQ ID NO: 1107 | human Protein crumbs homolog 1-EGF8 protein | PRT1107 |
| SEQ ID NO: 1108 | human Protein crumbs homolog 1-EGF9 protein | PRT1108 |
| SEQ ID NO: 1109 | human Protein crumbs homolog 2-EGF1 protein | PRT1109 |
| SEQ ID NO: 1110 | human Protein crumbs homolog 2-EGF10 protein | PRT1110 |
| SEQ ID NO: 1111 | human Protein crumbs homolog 2-EGF11 protein | PRT1111 |
| SEQ ID NO: 1112 | human Protein crumbs homolog 2-EGF12 protein | PRT1112 |
| SEQ ID NO: 1113 | human Protein crumbs homolog 2-EGF13 protein | PRT1113 |
| SEQ ID NO: 1114 | human Protein crumbs homolog 2-EGF14 protein | PRT1114 |
| SEQ ID NO: 1115 | human Protein crumbs homolog 2-EGF15 protein | PRT1115 |
| SEQ ID NO: 1116 | human Protein crumbs homolog 2-EGF2 protein | PRT1116 |
| SEQ ID NO: 1117 | human Protein crumbs homolog 2-EGF3 protein | PRT1117 |
| SEQ ID NO: 1118 | human Protein crumbs homolog 2-EGF4 protein | PRT1118 |
| SEQ ID NO: 1119 | human Protein crumbs homolog 2-EGF5 protein | PRT1119 |
| SEQ ID NO: 1120 | human Protein crumbs homolog 2-EGF6 protein | PRT1120 |
| SEQ ID NO: 1121 | human Protein crumbs homolog 2-EGF7 protein | PRT1121 |
| SEQ ID NO: 1122 | human Protein crumbs homolog 2-EGF8 protein | PRT1122 |
| SEQ ID NO: 1123 | human Protein crumbs homolog 2-EGF9 protein | PRT1123 |
| SEQ ID NO: 1124 | human Protein delta homolog 1-EGF1 protein | PRT1124 |
| SEQ ID NO: 1125 | human Protein delta homolog 1-EGF2 protein | PRT1125 |
| SEQ ID NO: 1126 | human Protein delta homolog 1-EGF3 protein | PRT1126 |
| SEQ ID NO: 1127 | human Protein delta homolog 1-EGF4 protein | PRT1127 |
| SEQ ID NO: 1128 | human Protein delta homolog 1-EGF5 protein | PRT1128 |
| SEQ ID NO: 1129 | human Protein delta homolog 1-EGF6 protein | PRT1129 |
| SEQ ID NO: 1130 | human Protein delta homolog 2-EGF1 protein | PRT1130 |
| SEQ ID NO: 1131 | human Protein delta homolog 2-EGF2 protein | PRT1131 |
| SEQ ID NO: 1132 | human Protein delta homolog 2-EGF3 protein | PRT1132 |
| SEQ ID NO: 1133 | human Protein delta homolog 2-EGF4 protein | PRT1133 |
| SEQ ID NO: 1134 | human Protein delta homolog 2-EGF5 protein | PRT1134 |
| SEQ ID NO: 1135 | human Protein delta homolog 2-EGF6 protein | PRT1135 |
| SEQ ID NO: 1136 | human Protein eyes shut homolog-EGF1 protein | PRT1136 |
| SEQ ID NO: 1137 | human Protein eyes shut homolog-EGF10 protein | PRT1137 |
| SEQ ID NO: 1138 | human Protein eyes shut homolog-EGF11 protein | PRT1138 |
| SEQ ID NO: 1139 | human Protein eyes shut homolog-EGF12 protein | PRT1139 |
| SEQ ID NO: 1140 | human Protein eyes shut homolog-EGF13 protein | PRT1140 |
| SEQ ID NO: 1141 | human Protein eyes shut homolog-EGF14 protein | PRT1141 |
| SEQ ID NO: 1142 | human Protein eyes shut homolog-EGF15 protein | PRT1142 |
| SEQ ID NO: 1143 | human Protein eyes shut homolog-EGF16 protein | PRT1143 |
| SEQ ID NO: 1144 | human Protein eyes shut homolog-EGF17 protein | PRT1144 |
| SEQ ID NO: 1145 | human Protein eyes shut homolog-EGF18 protein | PRT1145 |
| SEQ ID NO: 1146 | human Protein eyes shut homolog-EGF19 protein | PRT1146 |
| SEQ ID NO: 1147 | human Protein eyes shut homolog-EGF2 protein | PRT1147 |
| SEQ ID NO: 1148 | human Protein eyes shut homolog-EGF20 protein | PRT1148 |
| SEQ ID NO: 1149 | human Protein eyes shut homolog-EGF21 protein | PRT1149 |
| SEQ ID NO: 1150 | human Protein eyes shut homolog-EGF22 protein | PRT1150 |
| SEQ ID NO: 1151 | human Protein eyes shut homolog-EGF23 protein | PRT1151 |
| SEQ ID NO: 1152 | human Protein eyes shut homolog-EGF24 protein | PRT1152 |
| SEQ ID NO: 1153 | human Protein eyes shut homolog-EGF25 protein | PRT1153 |
| SEQ ID NO: 1154 | human Protein eyes shut homolog-EGF26 protein | PRT1154 |
| SEQ ID NO: 1155 | human Protein eyes shut homolog-EGF27 protein | PRT1155 |
| SEQ ID NO: 1156 | human Protein eyes shut homolog-EGF3 protein | PRT1156 |
| SEQ ID NO: 1157 | human Protein eyes shut homolog-EGF4 protein | PRT1157 |
| SEQ ID NO: 1158 | human Protein eyes shut homolog-EGF5 protein | PRT1158 |
| SEQ ID NO: 1159 | human Protein eyes shut homolog-EGF6 protein | PRT1159 |
| SEQ ID NO: 1160 | human Protein eyes shut homolog-EGF7 protein | PRT1160 |
| SEQ ID NO: 1161 | human Protein eyes shut homolog-EGF8 protein | PRT1161 |
| SEQ ID NO: 1162 | human Protein eyes shut homolog-EGF9 protein | PRT1162 |
| SEQ ID NO: 1163 | human Protein HEG homolog 1-EGF1 protein | PRT1163 |
| SEQ ID NO: 1164 | human Protein HEG homolog 1-EGF2 protein | PRT1164 |
| SEQ ID NO: 1165 | human Protein jagged-1-EGF1 protein | PRT1165 |
| SEQ ID NO: 1166 | human Protein jagged-1-EGF10 protein | PRT1166 |
| SEQ ID NO: 1167 | human Protein jagged-1-EGF11 protein | PRT1167 |
| SEQ ID NO: 1168 | human Protein jagged-1-EGF12 protein | PRT1168 |
| SEQ ID NO: 1169 | human Protein jagged-1-EGF13 protein | PRT1169 |
| SEQ ID NO: 1170 | human Protein jagged-1-EGF14 protein | PRT1170 |
| SEQ ID NO: 1171 | human Protein jagged-1-EGF15 protein | PRT1171 |
| SEQ ID NO: 1172 | human Protein jagged-1-EGF16 protein | PRT1172 |
| SEQ ID NO: 1173 | human Protein jagged-1-EGF2 protein | PRT1173 |

TABLE 1-continued

Designation of the human-originated EGF domain proteins set forth in the present invention

| No. in the sequence listing | Designation | Code in the invention |
| --- | --- | --- |
| SEQ ID NO: 1174 | human Protein jagged-1-EGF3 protein | PRT1174 |
| SEQ ID NO: 1175 | human Protein jagged-1-EGF4 protein | PRT1175 |
| SEQ ID NO: 1176 | human Protein jagged-1-EGF5 protein | PRT1176 |
| SEQ ID NO: 1177 | human Protein jagged-1-EGF6 protein | PRT1177 |
| SEQ ID NO: 1178 | human Protein jagged-1-EGF7 protein | PRT1178 |
| SEQ ID NO: 1179 | human Protein jagged-1-EGF8 protein | PRT1179 |
| SEQ ID NO: 1180 | human Protein jagged-1-EGF9 protein | PRT1180 |
| SEQ ID NO: 1181 | human Protein jagged-2-EGF1 protein | PRT1181 |
| SEQ ID NO: 1182 | human Protein jagged-2-EGF10 protein | PRT1182 |
| SEQ ID NO: 1183 | human Protein jagged-2-EGF11 protein | PRT1183 |
| SEQ ID NO: 1184 | human Protein jagged-2-EGF12 protein | PRT1184 |
| SEQ ID NO: 1185 | human Protein jagged-2-EGF13 protein | PRT1185 |
| SEQ ID NO: 1186 | human Protein jagged-2-EGF14 protein | PRT1186 |
| SEQ ID NO: 1187 | human Protein jagged-2-EGF15 protein | PRT1187 |
| SEQ ID NO: 1188 | human Protein jagged-2-EGF16 protein | PRT1188 |
| SEQ ID NO: 1189 | human Protein jagged-2-EGF2 protein | PRT1189 |
| SEQ ID NO: 1190 | human Protein jagged-2-EGF3 protein | PRT1190 |
| SEQ ID NO: 1191 | human Protein jagged-2-EGF4 protein | PRT1191 |
| SEQ ID NO: 1192 | human Protein jagged-2-EGF5 protein | PRT1192 |
| SEQ ID NO: 1193 | human Protein jagged-2-EGF6 protein | PRT1193 |
| SEQ ID NO: 1194 | human Protein jagged-2-EGF7 protein | PRT1194 |
| SEQ ID NO: 1195 | human Protein jagged-2-EGF8 protein | PRT1195 |
| SEQ ID NO: 1196 | human Protein jagged-2-EGF9 protein | PRT1196 |
| SEQ ID NO: 1197 | human Protein kinase C-binding protein NELL1-EGF1 protein | PRT1197 |
| SEQ ID NO: 1198 | human Protein kinase C-binding protein NELL1-EGF2 protein | PRT1198 |
| SEQ ID NO: 1199 | human Protein kinase C-binding protein NELL1-EGF3 protein | PRT1199 |
| SEQ ID NO: 1200 | human Protein kinase C-binding protein NELL1-EGF4 protein | PRT1200 |
| SEQ ID NO: 1201 | human Protein kinase C-binding protein NELL1-EGF5 protein | PRT1201 |
| SEQ ID NO: 1202 | human Protein kinase C-binding protein NELL2-EGF1 protein | PRT1202 |
| SEQ ID NO: 1203 | human Protein kinase C-binding protein NELL2-EGF2 protein | PRT1203 |
| SEQ ID NO: 1204 | human Protein kinase C-binding protein NELL2-EGF3 protein | PRT1204 |
| SEQ ID NO: 1205 | human Protein kinase C-binding protein NELL2-EGF4 protein | PRT1205 |
| SEQ ID NO: 1206 | human Protein kinase C-binding protein NELL2-EGF5 protein | PRT1206 |
| SEQ ID NO: 1207 | human Protein kinase C-binding protein NELL2-EGF6 protein | PRT1207 |
| SEQ ID NO: 1208 | human Protocadherin Fat 1-EGF1 protein | PRT1208 |
| SEQ ID NO: 1209 | human Protocadherin Fat 1-EGF2 protein | PRT1209 |
| SEQ ID NO: 1210 | human Protocadherin Fat 1-EGF3 protein | PRT1210 |
| SEQ ID NO: 1211 | human Protocadherin Fat 1-EGF4 protein | PRT1211 |
| SEQ ID NO: 1212 | human Protocadherin Fat 1-EGF5 protein | PRT1212 |
| SEQ ID NO: 1213 | human Protocadherin Fat 2-EGF1 protein | PRT1213 |
| SEQ ID NO: 1214 | human Protocadherin Fat 2-EGF2 protein | PRT1214 |
| SEQ ID NO: 1215 | human Protocadherin Fat 3-EGF1 protein | PRT1215 |
| SEQ ID NO: 1216 | human Protocadherin Fat 3-EGF2 protein | PRT1216 |
| SEQ ID NO: 1217 | human Protocadherin Fat 3-EGF3 protein | PRT1217 |
| SEQ ID NO: 1218 | human Protocadherin Fat 3-EGF4 protein | PRT1218 |
| SEQ ID NO: 1219 | human Protocadherin Fat 4-EGF1 protein | PRT1219 |
| SEQ ID NO: 1220 | human Protocadherin Fat 4-EGF2 protein | PRT1220 |
| SEQ ID NO: 1221 | human Protocadherin Fat 4-EGF3 protein | PRT1221 |
| SEQ ID NO: 1222 | human Protocadherin Fat 4-EGF4 protein | PRT1222 |
| SEQ ID NO: 1223 | human Protocadherin Fat 4-EGF5 protein | PRT1223 |
| SEQ ID NO: 1224 | human Protocadherin Fat 4-EGF6 protein | PRT1224 |
| SEQ ID NO: 1225 | human Protransforming growth factor alpha-EGF1 protein | PRT1225 |
| SEQ ID NO: 1226 | human P-selectin-EGF1 protein | PRT1226 |
| SEQ ID NO: 1227 | human Putative disintegrin and metalloproteinase domain-containing protein 5-EGF1 protein | PRT1227 |
| SEQ ID NO: 1228 | human Putative EGF-like module-containing mucin-like hormone receptor-like 4-EGF1 protein | PRT1228 |
| SEQ ID NO: 1229 | human Putative EGF-like module-containing mucin-like hormone receptor-like 4-EGF2 protein | PRT1229 |
| SEQ ID NO: 1230 | human Putative teratocarcinoma-derived growth factor 3-EGF1 protein | PRT1230 |
| SEQ ID NO: 1231 | human Reelin-EGF1 protein | PRT1231 |
| SEQ ID NO: 1232 | human Reelin-EGF2 protein | PRT1232 |
| SEQ ID NO: 1233 | human Reelin-EGF3 protein | PRT1233 |
| SEQ ID NO: 1234 | human Reelin-EGF4 protein | PRT1234 |
| SEQ ID NO: 1235 | human Reelin-EGF5 protein | PRT1235 |
| SEQ ID NO: 1236 | human Reelin-EGF6 protein | PRT1236 |
| SEQ ID NO: 1237 | human Reelin-EGF7 protein | PRT1237 |
| SEQ ID NO: 1238 | human Reelin-EGF8 protein | PRT1238 |
| SEQ ID NO: 1239 | human Scavenger receptor class F member 1-EGF1 protein | PRT1239 |
| SEQ ID NO: 1240 | human Scavenger receptor class F member 1-EGF2 protein | PRT1240 |
| SEQ ID NO: 1241 | human Scavenger receptor class F member 1-EGF3 protein | PRT1241 |
| SEQ ID NO: 1242 | human Scavenger receptor class F member 1-EGF4 protein | PRT1242 |
| SEQ ID NO: 1243 | human Scavenger receptor class F member 1-EGF5 protein | PRT1243 |
| SEQ ID NO: 1244 | human Scavenger receptor class F member 1-EGF6 protein | PRT1244 |

TABLE 1-continued

Designation of the human-originated EGF domain proteins set forth in the present invention

| No. in the sequence listing | Designation | Code in the invention |
|---|---|---|
| SEQ ID NO: 1245 | human Scavenger receptor class F member 2-EGF1 protein | PRT1245 |
| SEQ ID NO: 1246 | human Scavenger receptor class F member 2-EGF2 protein | PRT1246 |
| SEQ ID NO: 1247 | human Scavenger receptor class F member 2-EGF3 protein | PRT1247 |
| SEQ ID NO: 1248 | human Scavenger receptor class F member 2-EGF4 protein | PRT1248 |
| SEQ ID NO: 1249 | human Scavenger receptor class F member 2-EGF5 protein | PRT1249 |
| SEQ ID NO: 1250 | human Scavenger receptor class F member 2-EGF6 protein | PRT1250 |
| SEQ ID NO: 1251 | human Scavenger receptor class F member 2-EGF7 protein | PRT1251 |
| SEQ ID NO: 1252 | human SCO-spondin-EGF1 protein | PRT1252 |
| SEQ ID NO: 1253 | human SCO-spondin-EGF2 protein | PRT1253 |
| SEQ ID NO: 1254 | human Signal peptide, CUB and EGF-like domain-containing protein 1-EGF1 protein | PRT1254 |
| SEQ ID NO: 1255 | human Signal peptide, CUB and EGF-like domain-containing protein 1-EGF2 protein | PRT1255 |
| SEQ ID NO: 1256 | human Signal peptide, CUB and EGF-like domain-containing protein 1-EGF3 protein | PRT1256 |
| SEQ ID NO: 1257 | human Signal peptide, CUB and EGF-like domain-containing protein 1-EGF4 protein | PRT1257 |
| SEQ ID NO: 1258 | human Signal peptide, CUB and EGF-like domain-containing protein 1-EGF5 protein | PRT1258 |
| SEQ ID NO: 1259 | human Signal peptide, CUB and EGF-like domain-containing protein 1-EGF6 protein | PRT1259 |
| SEQ ID NO: 1260 | human Signal peptide, CUB and EGF-like domain-containing protein 1-EGF7 protein | PRT1260 |
| SEQ ID NO: 1261 | human Signal peptide, CUB and EGF-like domain-containing protein 1-EGF8 protein | PRT1261 |
| SEQ ID NO: 1262 | human Signal peptide, CUB and EGF-like domain-containing protein 1-EGF9 protein | PRT1262 |
| SEQ ID NO: 1263 | human Signal peptide, CUB and EGF-like domain-containing protein 2-EGF1 protein | PRT1263 |
| SEQ ID NO: 1264 | human Signal peptide, CUB and EGF-like domain-containing protein 2-EGF2 protein | PRT1264 |
| SEQ ID NO: 1265 | human Signal peptide, CUB and EGF-like domain-containing protein 2-EGF3 protein | PRT1265 |
| SEQ ID NO: 1266 | human Signal peptide, CUB and EGF-like domain-containing protein 2-EGF4 protein | PRT1266 |
| SEQ ID NO: 1267 | human Signal peptide, CUB and EGF-like domain-containing protein 2-EGF5 protein | PRT1267 |
| SEQ ID NO: 1268 | human Signal peptide, CUB and EGF-like domain-containing protein 2-EGF6 protein | PRT1268 |
| SEQ ID NO: 1269 | human Signal peptide, CUB and EGF-like domain-containing protein 2-EGF7 protein | PRT1269 |
| SEQ ID NO: 1270 | human Signal peptide, CUB and EGF-like domain-containing protein 2-EGF8 protein | PRT1270 |
| SEQ ID NO: 1271 | human Signal peptide, CUB and EGF-like domain-containing protein 2-EGF9 protein | PRT1271 |
| SEQ ID NO: 1272 | human Signal peptide, CUB and EGF-like domain-containing protein 3-EGF1 protein | PRT1272 |
| SEQ ID NO: 1273 | human Signal peptide, CUB and EGF-like domain-containing protein 3-EGF2 protein | PRT1273 |
| SEQ ID NO: 1274 | human Signal peptide, CUB and EGF-like domain-containing protein 3-EGF3 protein | PRT1274 |
| SEQ ID NO: 1275 | human Signal peptide, CUB and EGF-like domain-containing protein 3-EGF4 protein | PRT1275 |
| SEQ ID NO: 1276 | human Signal peptide, CUB and EGF-like domain-containing protein 3-EGF5 protein | PRT1276 |
| SEQ ID NO: 1277 | human Signal peptide, CUB and EGF-like domain-containing protein 3-EGF6 protein | PRT1277 |
| SEQ ID NO: 1278 | human Signal peptide, CUB and EGF-like domain-containing protein 3-EGF7 protein | PRT1278 |
| SEQ ID NO: 1279 | human Signal peptide, CUB and EGF-like domain-containing protein 3-EGF8 protein | PRT1279 |
| SEQ ID NO: 1280 | human Signal peptide, CUB and EGF-like domain-containing protein 3-EGF9 protein | PRT1280 |
| SEQ ID NO: 1281 | human Slit homolog 1 protein-EGF1 protein | PRT1281 |
| SEQ ID NO: 1282 | human Slit homolog 1 protein-EGF2 protein | PRT1282 |
| SEQ ID NO: 1283 | human Slit homolog 1 protein-EGF3 protein | PRT1283 |
| SEQ ID NO: 1284 | human Slit homolog 1 protein-EGF4 protein | PRT1284 |
| SEQ ID NO: 1285 | human Slit homolog 1 protein-EGF5 protein | PRT1285 |
| SEQ ID NO: 1286 | human Slit homolog 1 protein-EGF6 protein | PRT1286 |
| SEQ ID NO: 1287 | human Slit homolog 1 protein-EGF7 protein | PRT1287 |
| SEQ ID NO: 1288 | human Slit homolog 1 protein-EGF8 protein | PRT1288 |
| SEQ ID NO: 1289 | human Slit homolog 1 protein-EGF9 protein | PRT1289 |
| SEQ ID NO: 1290 | human Slit homolog 2 protein-EGF1 protein | PRT1290 |
| SEQ ID NO: 1291 | human Slit homolog 2 protein-EGF2 protein | PRT1291 |
| SEQ ID NO: 1292 | human Slit homolog 2 protein-EGF3 protein | PRT1292 |

TABLE 1-continued

Designation of the human-originated EGF domain proteins set forth in the present invention

| No. in the sequence listing | Designation | Code in the invention |
|---|---|---|
| SEQ ID NO: 1293 | human Slit homolog 2 protein-EGF4 protein | PRT1293 |
| SEQ ID NO: 1294 | human Slit homolog 2 protein-EGF5 protein | PRT1294 |
| SEQ ID NO: 1295 | human Slit homolog 2 protein-EGF6 protein | PRT1295 |
| SEQ ID NO: 1296 | human Slit homolog 2 protein-EGF7 protein | PRT1296 |
| SEQ ID NO: 1297 | human Slit homolog 3 protein-EGF1 protein | PRT1297 |
| SEQ ID NO: 1298 | human Slit homolog 3 protein-EGF2 protein | PRT1298 |
| SEQ ID NO: 1299 | human Slit homolog 3 protein-EGF3 protein | PRT1299 |
| SEQ ID NO: 1300 | human Slit homolog 3 protein-EGF4 protein | PRT1300 |
| SEQ ID NO: 1301 | human Slit homolog 3 protein-EGF5 protein | PRT1301 |
| SEQ ID NO: 1302 | human Slit homolog 3 protein-EGF6 protein | PRT1302 |
| SEQ ID NO: 1303 | human Slit homolog 3 protein-EGF7 protein | PRT1303 |
| SEQ ID NO: 1304 | human Slit homolog 3 protein-EGF8 protein | PRT1304 |
| SEQ ID NO: 1305 | human Slit homolog 3 protein-EGF9 protein | PRT1305 |
| SEQ ID NO: 1306 | human Sortilin-related receptor-EGF1 protein | PRT1306 |
| SEQ ID NO: 1307 | human Stabilin-1-EGF1 protein | PRT1307 |
| SEQ ID NO: 1308 | human Stabilin-1-EGF10 protein | PRT1308 |
| SEQ ID NO: 1309 | human Stabilin-1-EGF11 protein | PRT1309 |
| SEQ ID NO: 1310 | human Stabilin-1-EGF12 protein | PRT1310 |
| SEQ ID NO: 1311 | human Stabilin-1-EGF13 protein | PRT1311 |
| SEQ ID NO: 1312 | human Stabilin-1-EGF14 protein | PRT1312 |
| SEQ ID NO: 1313 | human Stabilin-1-EGF15 protein | PRT1313 |
| SEQ ID NO: 1314 | human Stabilin-1-EGF16 protein | PRT1314 |
| SEQ ID NO: 1315 | human Stabilin-1-EGF2 protein | PRT1315 |
| SEQ ID NO: 1316 | human Stabilin-1-EGF3 protein | PRT1316 |
| SEQ ID NO: 1317 | human Stabilin-1-EGF4 protein | PRT1317 |
| SEQ ID NO: 1318 | human Stabilin-1-EGF5 protein | PRT1318 |
| SEQ ID NO: 1319 | human Stabilin-1-EGF6 protein | PRT1319 |
| SEQ ID NO: 1320 | human Stabilin-1-EGF7 protein | PRT1320 |
| SEQ ID NO: 1321 | human Stabilin-1-EGF8 protein | PRT1321 |
| SEQ ID NO: 1322 | human Stabilin-1-EGF9 protein | PRT1322 |
| SEQ ID NO: 1323 | human Stabilin-2-EGF1 protein | PRT1323 |
| SEQ ID NO: 1324 | human Stabilin-2-EGF10 protein | PRT1324 |
| SEQ ID NO: 1325 | human Stabilin-2-EGF11 protein | PRT1325 |
| SEQ ID NO: 1326 | human Stabilin-2-EGF12 protein | PRT1326 |
| SEQ ID NO: 1327 | human Stabilin-2-EGF13 protein | PRT1327 |
| SEQ ID NO: 1328 | human Stabilin-2-EGF14 protein | PRT1328 |
| SEQ ID NO: 1329 | human Stabilin-2-EGF15 protein | PRT1329 |
| SEQ ID NO: 1330 | human Stabilin-2-EGF16 protein | PRT1330 |
| SEQ ID NO: 1331 | human Stabilin-2-EGF17 protein | PRT1331 |
| SEQ ID NO: 1332 | human Stabilin-2-EGF2 protein | PRT1332 |
| SEQ ID NO: 1333 | human Stabilin-2-EGF3 protein | PRT1333 |
| SEQ ID NO: 1334 | human Stabilin-2-EGF4 protein | PRT1334 |
| SEQ ID NO: 1335 | human Stabilin-2-EGF5 protein | PRT1335 |
| SEQ ID NO: 1336 | human Stabilin-2-EGF6 protein | PRT1336 |
| SEQ ID NO: 1337 | human Stabilin-2-EGF7 protein | PRT1337 |
| SEQ ID NO: 1338 | human Stabilin-2-EGF8 protein | PRT1338 |
| SEQ ID NO: 1339 | human Stabilin-2-EGF9 protein | PRT1339 |
| SEQ ID NO: 1340 | human Sushi domain-containing protein 1-EGF1 protein | PRT1340 |
| SEQ ID NO: 1341 | human Sushi domain-containing protein 1-EGF2 protein | PRT1341 |
| SEQ ID NO: 1342 | human Sushi domain-containing protein 1-EGF3 protein | PRT1342 |
| SEQ ID NO: 1343 | human Sushi, von Willebrand factor type A, EGF and pentraxin domain-containing protein 1-EGF1 protein | PRT1343 |
| SEQ ID NO: 1344 | human Sushi, von Willebrand factor type A, EGF and pentraxin domain-containing protein 1-EGF2 protein | PRT1344 |
| SEQ ID NO: 1345 | human Sushi, von Willebrand factor type A, EGF and pentraxin domain-containing protein 1-EGF3 protein | PRT1345 |
| SEQ ID NO: 1346 | human Sushi, von Willebrand factor type A, EGF and pentraxin domain-containing protein 1-EGF4 protein | PRT1346 |
| SEQ ID NO: 1347 | human Sushi, von Willebrand factor type A, EGF and pentraxin domain-containing protein 1-EGF5 protein | PRT1347 |
| SEQ ID NO: 1348 | human Sushi, von Willebrand factor type A, EGF and pentraxin domain-containing protein 1-EGF6 protein | PRT1348 |
| SEQ ID NO: 1349 | human Sushi, von Willebrand factor type A, EGF and pentraxin domain-containing protein 1-EGF7 protein | PRT1349 |
| SEQ ID NO: 1350 | human Sushi, von Willebrand factor type A, EGF and pentraxin domain-containing protein 1-EGF8 protein | PRT1350 |
| SEQ ID NO: 1351 | human Sushi, von Willebrand factor type A, EGF and pentraxin domain-containing protein 1-EGF9 protein | PRT1351 |
| SEQ ID NO: 1352 | human Tenascin-EGF1 protein | PRT1352 |
| SEQ ID NO: 1353 | human Tenascin-EGF10 protein | PRT1353 |
| SEQ ID NO: 1354 | human Tenascin-EGF11 protein | PRT1354 |
| SEQ ID NO: 1355 | human Tenascin-EGF12 protein | PRT1355 |
| SEQ ID NO: 1356 | human Tenascin-EGF13 protein | PRT1356 |
| SEQ ID NO: 1357 | human Tenascin-EGF14 protein | PRT1357 |
| SEQ ID NO: 1358 | human Tenascin-EGF2 protein | PRT1358 |

TABLE 1-continued

Designation of the human-originated EGF domain proteins set forth in the present invention

| No. in the sequence listing | Designation | Code in the invention |
|---|---|---|
| SEQ ID NO: 1359 | human Tenascin-EGF3 protein | PRT1359 |
| SEQ ID NO: 1360 | human Tenascin-EGF4 protein | PRT1360 |
| SEQ ID NO: 1361 | human Tenascin-EGF5 protein | PRT1361 |
| SEQ ID NO: 1362 | human Tenascin-EGF6 protein | PRT1362 |
| SEQ ID NO: 1363 | human Tenascin-EGF7 protein | PRT1363 |
| SEQ ID NO: 1364 | human Tenascin-EGF8 protein | PRT1364 |
| SEQ ID NO: 1365 | human Tenascin-EGF9 protein | PRT1365 |
| SEQ ID NO: 1366 | human Tenascin-N-EGF1 protein | PRT1366 |
| SEQ ID NO: 1367 | human Tenascin-N-EGF2 protein | PRT1367 |
| SEQ ID NO: 1368 | human Tenascin-N-EGF3 protein | PRT1368 |
| SEQ ID NO: 1369 | human Tenascin-X-EGF1 protein | PRT1369 |
| SEQ ID NO: 1370 | human Tenascin-X-EGF10 protein | PRT1370 |
| SEQ ID NO: 1371 | human Tenascin-X-EGF11 protein | PRT1371 |
| SEQ ID NO: 1372 | human Tenascin-X-EGF12 protein | PRT1372 |
| SEQ ID NO: 1373 | human Tenascin-X-EGF13 protein | PRT1373 |
| SEQ ID NO: 1374 | human Tenascin-X-EGF14 protein | PRT1374 |
| SEQ ID NO: 1375 | human Tenascin-X-EGF15 protein | PRT1375 |
| SEQ ID NO: 1376 | human Tenascin-X-EGF16 protein | PRT1376 |
| SEQ ID NO: 1377 | human Tenascin-X-EGF17 protein | PRT1377 |
| SEQ ID NO: 1378 | human Tenascin-X-EGF18 protein | PRT1378 |
| SEQ ID NO: 1379 | human Tenascin-X-EGF2 protein | PRT1379 |
| SEQ ID NO: 1380 | human Tenascin-X-EGF3 protein | PRT1380 |
| SEQ ID NO: 1381 | human Tenascin-X-EGF4 protein | PRT1381 |
| SEQ ID NO: 1382 | human Tenascin-X-EGF5 protein | PRT1382 |
| SEQ ID NO: 1383 | human Tenascin-X-EGF6 protein | PRT1383 |
| SEQ ID NO: 1384 | human Tenascin-X-EGF7 protein | PRT1384 |
| SEQ ID NO: 1385 | human Tenascin-X-EGF8 protein | PRT1385 |
| SEQ ID NO: 1386 | human Tenascin-X-EGF9 protein | PRT1386 |
| SEQ ID NO: 1387 | human Teneurin-1-EGF1 protein | PRT1387 |
| SEQ ID NO: 1388 | human Teneurin-1-EGF2 protein | PRT1388 |
| SEQ ID NO: 1389 | human Teneurin-1-EGF3 protein | PRT1389 |
| SEQ ID NO: 1390 | human Teneurin-1-EGF4 protein | PRT1390 |
| SEQ ID NO: 1391 | human Teneurin-1-EGF5 protein | PRT1391 |
| SEQ ID NO: 1392 | human Teneurin-1-EGF6 protein | PRT1392 |
| SEQ ID NO: 1393 | human Teneurin-1-EGF7 protein | PRT1393 |
| SEQ ID NO: 1394 | human Teneurin-1-EGF8 protein | PRT1394 |
| SEQ ID NO: 1395 | human Teneurin-2-EGF1 protein | PRT1395 |
| SEQ ID NO: 1396 | human Teneurin-2-EGF2 protein | PRT1396 |
| SEQ ID NO: 1397 | human Teneurin-2-EGF3 protein | PRT1397 |
| SEQ ID NO: 1398 | human Teneurin-2-EGF4 protein | PRT1398 |
| SEQ ID NO: 1399 | human Teneurin-2-EGF5 protein | PRT1399 |
| SEQ ID NO: 1400 | human Teneurin-2-EGF6 protein | PRT1400 |
| SEQ ID NO: 1401 | human Teneurin-2-EGF7 protein | PRT1401 |
| SEQ ID NO: 1402 | human Teneurin-2-EGF8 protein | PRT1402 |
| SEQ ID NO: 1403 | human Teneurin-3-EGF1 protein | PRT1403 |
| SEQ ID NO: 1404 | human Teneurin-3-EGF2 protein | PRT1404 |
| SEQ ID NO: 1405 | human Teneurin-3-EGF3 protein | PRT1405 |
| SEQ ID NO: 1406 | human Teneurin-3-EGF4 protein | PRT1406 |
| SEQ ID NO: 1407 | human Teneurin-3-EGF5 protein | PRT1407 |
| SEQ ID NO: 1408 | human Teneurin-3-EGF6 protein | PRT1408 |
| SEQ ID NO: 1409 | human Teneurin-3-EGF7 protein | PRT1409 |
| SEQ ID NO: 1410 | human Teneurin-3-EGF8 protein | PRT1410 |
| SEQ ID NO: 1411 | human Teneurin-4-EGF1 protein | PRT1411 |
| SEQ ID NO: 1412 | human Teneurin-4-EGF2 protein | PRT1412 |
| SEQ ID NO: 1413 | human Teneurin-4-EGF3 protein | PRT1413 |
| SEQ ID NO: 1414 | human Teneurin-4-EGF4 protein | PRT1414 |
| SEQ ID NO: 1415 | human Teneurin-4-EGF5 protein | PRT1415 |
| SEQ ID NO: 1416 | human Teneurin-4-EGF6 protein | PRT1416 |
| SEQ ID NO: 1417 | human Teneurin-4-EGF7 protein | PRT1417 |
| SEQ ID NO: 1418 | human Teneurin-4-EGF8 protein | PRT1418 |
| SEQ ID NO: 1419 | human Teratocarcinoma-derived growth factor 1-EGF1 protein | PRT1419 |
| SEQ ID NO: 1420 | human Thrombomodulin-EGF1 protein | PRT1420 |
| SEQ ID NO: 1421 | human Thrombomodulin-EGF2 protein | PRT1421 |
| SEQ ID NO: 1422 | human Thrombomodulin-EGF3 protein | PRT1422 |
| SEQ ID NO: 1423 | human Thrombomodulin-EGF4 protein | PRT1423 |
| SEQ ID NO: 1424 | human Thrombomodulin-EGF5 protein | PRT1424 |
| SEQ ID NO: 1425 | human Thrombomodulin-EGF6 protein | PRT1425 |
| SEQ ID NO: 1426 | human Thrombospondin-1-EGF1 protein | PRT1426 |
| SEQ ID NO: 1427 | human Thrombospondin-1-EGF2 protein | PRT1427 |
| SEQ ID NO: 1428 | human Thrombospondin-2-EGF1 protein | PRT1428 |
| SEQ ID NO: 1429 | human Thrombospondin-2-EGF2 protein | PRT1429 |
| SEQ ID NO: 1430 | human Thrombospondin-3-EGF1 protein | PRT1430 |
| SEQ ID NO: 1431 | human Thrombospondin-3-EGF2 protein | PRT1431 |
| SEQ ID NO: 1432 | human Thrombospondin-3-EGF3 protein | PRT1432 |
| SEQ ID NO: 1433 | human Thrombospondin-4-EGF1 protein | PRT1433 |

TABLE 1-continued

Designation of the human-originated EGF domain proteins set forth in the present invention

| No. in the sequence listing | Designation | Code in the invention |
|---|---|---|
| SEQ ID NO: 1434 | human Thrombospondin-4-EGF2 protein | PRT1434 |
| SEQ ID NO: 1435 | human Thrombospondin-4-EGF3 protein | PRT1435 |
| SEQ ID NO: 1436 | human Thrombospondin-4-EGF4 protein | PRT1436 |
| SEQ ID NO: 1437 | human Thyroid peroxidase-EGF1 protein | PRT1437 |
| SEQ ID NO: 1438 | human Tissue-type plasminogen activator-EGF1 protein | PRT1438 |
| SEQ ID NO: 1439 | human Tolloid-like protein 1-EGF1 protein | PRT1439 |
| SEQ ID NO: 1440 | human Tolloid-like protein 1-EGF2 protein | PRT1440 |
| SEQ ID NO: 1441 | human Tolloid-like protein 2-EGF1 protein | PRT1441 |
| SEQ ID NO: 1442 | human Tolloid-like protein 2-EGF2 protein | PRT1442 |
| SEQ ID NO: 1443 | human Tomoregulin-1-EGF1 protein | PRT1443 |
| SEQ ID NO: 1444 | human Tomoregulin-2-EGF1 protein | PRT1444 |
| SEQ ID NO: 1445 | human Transmembrane protein 8A-EGF1 protein | PRT1445 |
| SEQ ID NO: 1446 | human Transmembrane protein 8B-EGF1 protein | PRT1446 |
| SEQ ID NO: 1447 | human Tyrosine-protein kinase receptor Tie-1-EGF1 protein | PRT1447 |
| SEQ ID NO: 1448 | human Tyrosine-protein kinase receptor Tie-1-EGF2 protein | PRT1448 |
| SEQ ID NO: 1449 | human Tyrosine-protein kinase receptor Tie-1-EGF3 protein | PRT1449 |
| SEQ ID NO: 1450 | human Urokinase-type plasminogen activator-EGF1 protein | PRT1450 |
| SEQ ID NO: 1451 | human Uromodulin-EGF1 protein | PRT1451 |
| SEQ ID NO: 1452 | human Uromodulin-EGF2 protein | PRT1452 |
| SEQ ID NO: 1453 | human Uromodulin-EGF3 protein | PRT1453 |
| SEQ ID NO: 1454 | human Uromodulin-like 1-EGF1 protein | PRT1454 |
| SEQ ID NO: 1455 | human Uromodulin-like 1-EGF2 protein | PRT1455 |
| SEQ ID NO: 1456 | human Uromodulin-like 1-EGF3 protein | PRT1456 |
| SEQ ID NO: 1457 | human Usherin-EGF1 protein | PRT1457 |
| SEQ ID NO: 1458 | human Usherin-EGF10 protein | PRT1458 |
| SEQ ID NO: 1459 | human Usherin-EGF2 protein | PRT1459 |
| SEQ ID NO: 1460 | human Usherin-EGF3 protein | PRT1460 |
| SEQ ID NO: 1461 | human Usherin-EGF4 protein | PRT1461 |
| SEQ ID NO: 1462 | human Usherin-EGF5 protein | PRT1462 |
| SEQ ID NO: 1463 | human Usherin-EGF6 protein | PRT1463 |
| SEQ ID NO: 1464 | human Usherin-EGF7 protein | PRT1464 |
| SEQ ID NO: 1465 | human Usherin-EGF8 protein | PRT1465 |
| SEQ ID NO: 1466 | human Usherin-EGF9 protein | PRT1466 |
| SEQ ID NO: 1467 | human Vasorin-EGF1 protein | PRT1467 |
| SEQ ID NO: 1468 | human Versican core protein-EGF1 protein | PRT1468 |
| SEQ ID NO: 1469 | human Very low-density lipoprotein receptor-EGF1 protein | PRT1469 |
| SEQ ID NO: 1470 | human Very low-density lipoprotein receptor-EGF2 protein | PRT1470 |
| SEQ ID NO: 1471 | human Very low-density lipoprotein receptor-EGF3 protein | PRT1471 |
| SEQ ID NO: 1472 | human Vitamin K-dependent protein C-EGF1 protein | PRT1472 |
| SEQ ID NO: 1473 | human Vitamin K-dependent protein C-EGF2 protein | PRT1473 |
| SEQ ID NO: 1474 | human Vitamin K-dependent protein S-EGF1 protein | PRT1474 |
| SEQ ID NO: 1475 | human Vitamin K-dependent protein S-EGF2 protein | PRT1475 |
| SEQ ID NO: 1476 | human Vitamin K-dependent protein S-EGF3 protein | PRT1476 |
| SEQ ID NO: 1477 | human Vitamin K-dependent protein S-EGF4 protein | PRT1477 |
| SEQ ID NO: 1478 | human Vitamin K-dependent protein Z-EGF1 protein | PRT1478 |
| SEQ ID NO: 1479 | human Vitamin K-dependent protein Z-EGF2 protein | PRT1479 |
| SEQ ID NO: 1480 | human von Willebrand factor A domain-containing protein 2-EGF1 protein | PRT1480 |
| SEQ ID NO: 1481 | human von Willebrand factor A domain-containing protein 2-EGF2 protein | PRT1481 |
| SEQ ID NO: 1482 | human von Willebrand factor C and EGF domain-containing protein-EGF1 protein | PRT1482 |
| SEQ ID NO: 1483 | human von Willebrand factor C and EGF domain-containing protein-EGF2 protein | PRT1483 |
| SEQ ID NO: 1484 | human von Willebrand factor C and EGF domain-containing protein-EGF3 protein | PRT1484 |
| SEQ ID NO: 1485 | human von Willebrand factor C and EGF domain-containing protein-EGF4 protein | PRT1485 |
| SEQ ID NO: 1486 | human von Willebrand factor D and EGF domain-containing protein-EGF1 protein | PRT1486 |
| SEQ ID NO: 1487 | human von Willebrand factor D and EGF domain-containing protein-EGF2 protein | PRT1487 |
| SEQ ID NO: 1488 | human von Willebrand factor D and EGF domain-containing protein-EGF3 protein | PRT1488 |
| SEQ ID NO: 1489 | human von Willebrand factor D and EGF domain-containing protein-EGF4 protein | PRT1489 |
| SEQ ID NO: 1490 | human von Willebrand factor D and EGF domain-containing protein-EGF5 protein | PRT1490 |
| SEQ ID NO: 1491 | human von Willebrand factor D and EGF domain-containing protein-EGF6 protein | PRT1491 |
| SEQ ID NO: 1492 | human von Willebrand factor D and EGF domain-containing protein-EGF7 protein | PRT1492 |
| SEQ ID NO: 1493 | human Wnt inhibitory factor 1-EGF1 protein | PRT1493 |
| SEQ ID NO: 1494 | human Wnt inhibitory factor 1-EGF2 protein | PRT1494 |
| SEQ ID NO: 1495 | human Wnt inhibitory factor 1-EGF3 protein | PRT1495 |

TABLE 1-continued

Designation of the human-originated EGF domain proteins set forth in the present invention

| No. in the sequence listing | Designation | Code in the invention |
|---|---|---|
| SEQ ID NO: 1496 | human Wnt inhibitory factor 1-EGF4 protein | PRT1496 |
| SEQ ID NO: 1497 | human Wnt inhibitory factor 1-EGF5 protein | PRT1497 |
| SEQ ID NO: 1498 | human Zonadhesin-EGF1 protein | PRT1498 |

The human-originated EGF domain proteins mentioned above are expressed from a prokaryotic or eukaryotic recombinant plasmid or prepared by chemical synthesis.

The steps used in the present invention are as follows:

(1) obtain a gene encoding the human-originated EGF domain protein hF VII-EGF1 or a gene having homology of more than 50% thereto, as well as a gene coding for a fluorescent protein by PCR amplification or artificial synthesis; and obtain a fusion gene encoding for the RFP fusion protein, RFP-hF VII-EGF1 human-originated EGF domain protein, or a gene for a fusion protein having homology of more than 50% to the aforementioned fusion protein through overlapping PCR amplification reaction;

(2) insert the individual gene fragments mentioned above encoding for the recombinant fusion proteins respectively into a prokaryotic or eukaryotic vector to construct the recombinant prokaryotic or eukaryotic plasmid, followed by transformation of the resultant recombinant plasmid into competent bacteria to be cultured, and then screen the recombinant plasmid comprising the correctly inserted fragments by sequencing;

(3) transform the recombinant prokaryotic plasmids with the correct sequencing result into an engineering bacterium to be expressed; isolate and purify the expressed protein to obtain the fusion protein RFP-hF VII-EGF1 or the protein having homology of more than 50% to the fusion protein; or transfect the resultant recombinant eukaryotic plasmids with the correct sequencing result into mammalian cells to be cultured, establish a stable cell line for eukaryotic expression, isolate and purify the expressed protein to obtain the fusion protein RFP-hF VII-EGF1 or the protein having homology of more than 50% to the fusion protein;

(4) release the recombination protein hF VII-EGF1 or the protein having homology of more than 50% thereto by enzymatic digestion with rTEV enzyme, and purify the protein;

(5) analyze the antibacterial activity of the recombination protein hF VII-EGF1 or the protein having homology of more than 50% thereto;

(6) analyze the hydrolysis of the lipopolysaccharide by the recombination protein hF VII-EGF1 or the protein having homology of more than 50% thereto by silver staining;

where the prokaryotic vector is the pET plasmid system which includes the prokaryotic expression plasmids such as pET-14b, pET-19b, pET-21a (+), pET-28a (+), pET-42a (+), etc; and the eukaryotic vector is pcDNA3.1 (+), pcDNA3.1 (−), etc.

Chemical synthesis of the human-originated EGF domain proteins is usually outsourced to professional companies.

It has been demonstrated experimentally that: 1498 of the human-originated EGF domain proteins (PRT1 to PRT1498 in Table 1) set forth in the present invention such as hF VII-EGF1 protein are able to hydrolyze the lipopolysaccharide of Gram-negative bacteria (also known as endotoxin, a major component in the outer-membrane of a Gram-negative bacterium) and disrupt the stability of cellular structure, thereby exerting the bactericidal action. Meanwhile, the human-originated EGF domain proteins such as hF VII-EGF1, hF VII-EGF2, hF IX-EGF1, hF IX-EGF2, hF X-EGF1, and hF X-EGF2, have very strong binding to the tissue factor. When the body is injured, the tissue factor will be exposed at the wound in a large amount, which allows such EGF domain-containing proteins to aggregate accordingly at the wound, exerting a targeted bacteriostatic effect. Assays on the antibacterial activity demonstrate that 1498 of the human-originated EGF domain proteins (PRT1 to PRT1498 in Table 1) such as hF VII-EGF1 protein can inhibit the Gram-negative bacteria significantly. The minimum inhibitory concentrations (MICs) of the abovementioned recombinant proteins for *E. coli* DH5α, *E. coli* BL21, *Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris, Serratia marcescens* are shown in Tables 2 and 3 in the Examples below.

1498 of the human-originated EGF domain proteins (PRT1 to PRT1498 in Table 1) set forth in the present invention such as hF VII-EGF1 protein can hydrolyze the lipopolysaccharide of Gram-negative bacteria (also known as endotoxin, seen in Example 17) and lipopolysaccharide is the major pathogenic factor causing endotoxemia. Therefore, 1498 of the human-originated EGF domain proteins (PRT1 to PRT1498 in Table 1) set forth in the present invention such as hF VII-EGF1 protein can be used in preparing a medicament for treating endotoxemia caused by the Gram-negative bacteria.

The present invention has the following advantageous effects:

1. 1498 of the artificially-prepared human-originated EGF domain proteins (PRT1 to PRT1498 in Table 1) provided in the present invention such as hF VII-EGF1 protein are able to hydrolyze the outer membrane of the Gram-negative bacteria and has been shown experimentally to have significant inhibitory effects on the Gram-negative bacteria, thereby providing a novel class of therapeutic drugs for treating diseases caused by the Gram-negative bacteria infection.

2. 1498 of the artificially-prepared human-originated EGF domain proteins (PRT1 to PRT1498 in Table 1) provided in the present invention such as hF VII-EGF1 protein are able to hydrolyze the lipopolysaccharide (also known as endotoxin) of the Gram-negative bacteria, thereby providing a novel class of therapeutic drugs for treating endotoxemia caused by the Gram-negative bacteria.

3. Six human-originated EGF domain proteins provided in the present invention which are artificially prepared, i.e. hF VII-EGF1, hF VII-EGF2, hF IX-EGF1, hF IX-EGF2, hF X-EGF1, and hF X-EGF2, can exhibit an excellent targeted bactericidal effect on Gram-negative bacteria at the wound site by targeted localization at the wound site via binding to tissue factor, and be prospective to be used in preparation of a novel targeted antibacterial drug.

4. 1498 of the human-originated EGF domain proteins (PRT1 to PRT1498 in Table 1) such as hF VII-EGF1 protein are natural and intrinsic components in the human body, and use of the EGF domain proteins as the bacteriostatic domain in the present invention can reduce the immunogenicity of the medicament effectively.

5. Since 1498 of the recombinant human-originated EGF domain proteins (PRT1 to PRT1498 in Table 1) such as hF VII-EGF1 protein could be expressed properly in cells of *E. coli* directly through the genetic engineering techniques, the production cost is lower, suitable for industrial production.

BRIEF DESCRIPTION OF ACCOMPANYING DRAWINGS

FIG. 1 is the electrophoregram of PCR amplification of the gene sequence encoding the recombinant protein hF VII-EGF1 in Example 1, wherein Lane 1 is the DNA molecular weight marker (Marker 1, purchased from TIANGEN BIOTECH Co. Ltd.) and Lane 2 is PCR amplification of the sequence encoding hF VII-EGF1. The arrowhead is directed toward the amplified fragment of interest.

Figure 4:
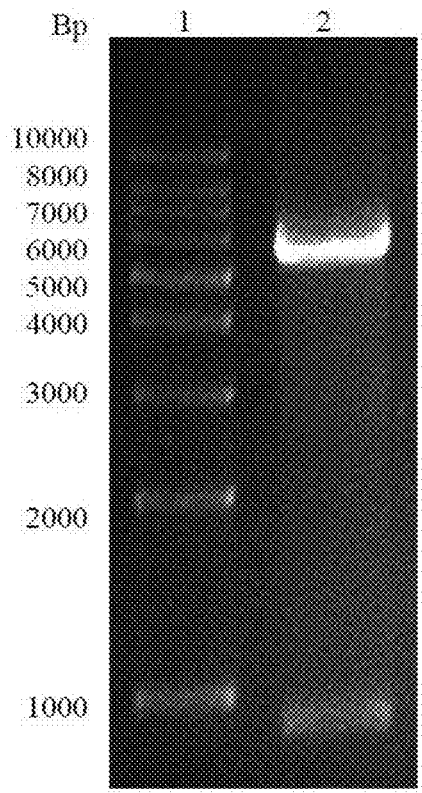

FIG. 4 is the electrophoregram for identification of the restriction-endonuclease digested fragments of the recombinant plasmid pET19bRFP-hF VII-EGF1 in Example 2, wherein Lane 1 is the DNA molecular weight marker (1 kb Marker, purchased from TIANGEN BIOTECH Co. Ltd.) and Lane 2 is the pET19b vector fragment and the DNA fragment encoding the recombinant protein RFP-hF VII-EGF1 which are obtained after restriction-endonuclease double digestion of the recombinant plasmid pET19bRFP-hF VII-EGF1.

Figure 5:
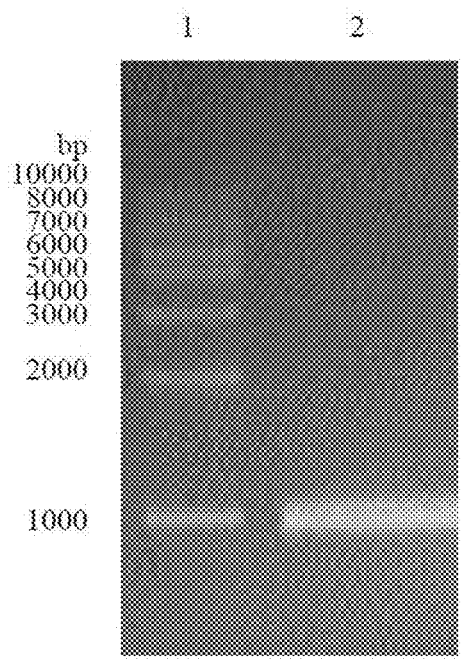

FIG. 5 is the electrophoregram of PCR amplification of the gene sequence encoding the fusion protein RFP-hF VII-EGF2 in Example 3, wherein Lane 1 is the DNA molecular weight marker (1 kb Marker, purchased from TIANGEN BIOTECH Co. Ltd.) and Lane 2 is PCR amplification of the sequence encoding RFP-hF VII-EGF2.

Figure 6:
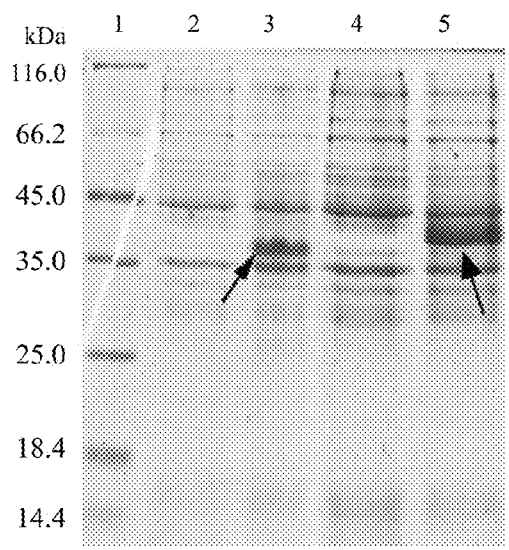

FIG. 6 is the SDS-PAGE analysis of inducible expression of the fusion proteins RFP-hF VII-EGF1 and RFP-hF VII-EGF2 from the recombinant plasmids pET19bRFP-hF VII-EGF1 and pET19bRFP-FVII-EGF2 in *E. coli* in Examples 5 and 8, wherein Lane 1 is the protein molecular weight marker (Unst. Protein Marker, purchased from Thermo Scientific); Lane 2 is the total protein of the *E. coli* without expressing the fusion protein RFP-hF VII-EGF1 before induction; Lane 3 is the total protein of the *E. coli* after expressing the fusion protein RFP-hF VII-EGF1 by induction; Lane 4 is the total protein of the *E. coli* without expressing the fusion protein RFP-hF VII-EGF2 before induction; and Lane 5 is the total protein of the *E. coli* after expressing the fusion protein RFP-hF VII-EGF2 by induction. The arrowheads indicate the expressed fusion proteins.

Figure 7:
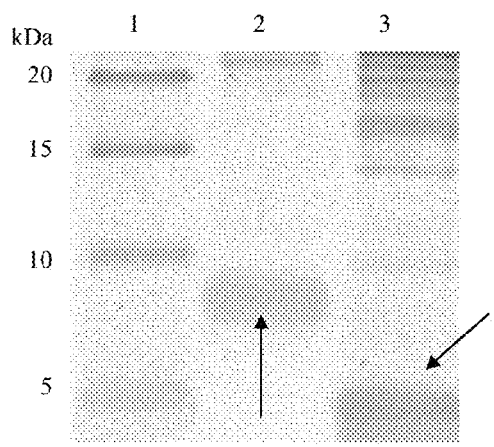

FIG. 7 is picture of Tricien gel analysis for identifying the recombination proteins hF VII-EGF1 and hF VII-EGF2 obtained after enzymatic digestion of the fusion proteins RFP-hF VII-EGF1 and RFP-hF VII-EGF2 with rTEV in Examples 7 and 8, in which Lane 1 is the lower molecular weight protein marker (PageRuler Unstained Low Range Protein Ladder, purchased from Thermo Scientific); Lane 2 is the recombination protein hF VII-EGF2 obtained after rTEV enzymatic digestion; Lane 3 is the recombination protein hF VII-EGF1 obtained after rTEV enzymatic digestion; and the arrowheads indicate the proteins of interest after enzymatic digestion.

Figure 8:
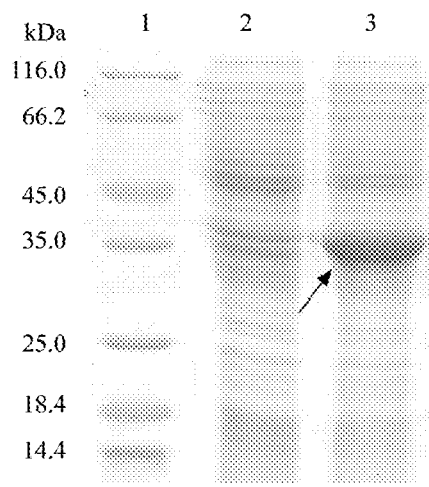

FIG. 8 is the SDS-PAGE analysis of inducible expression of the fusion protein RFP-hF IX-EGF1 from the recombinant plasmid pET21ahF IX-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-hF IX-EGF1 before induction; and Lane 3 is the total protein of the *E. coli* after expressing the fusion protein RFP-hF IX-EGF1 by induction. The arrowhead indicates the expressed fusion protein.

Figure 9:
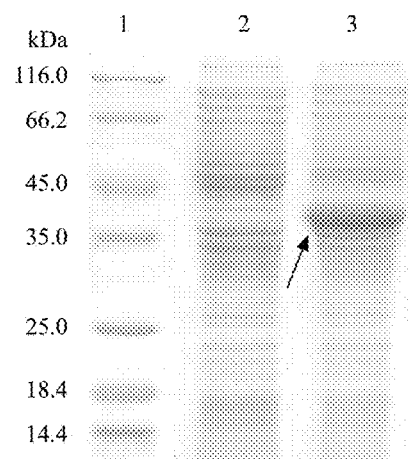

FIG. 9 is the SDS-PAGE analysis of inducible expression of the fusion protein RFP-hF IX-EGF2 from the recombinant plasmid pET21ahF IX-EGF2-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-hF IX-EGF2 before induction; and Lane 3 is the total protein of the *E. coli* after expressing the fusion protein RFP-hF IX-EGF2 by induction. The arrowhead indicates the expressed fusion protein.

Figure 10:
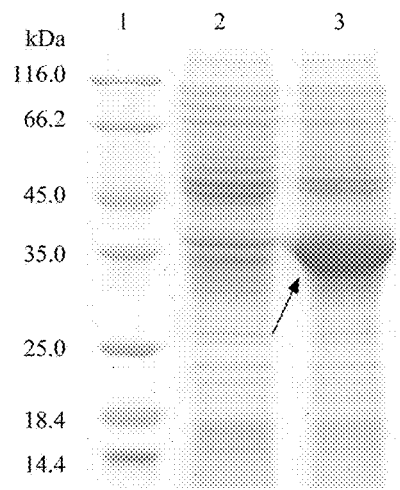

FIG. 10 is the SDS-PAGE analysis of inducible expression of the fusion protein RFP-hF X-EGF1 from the recombinant plasmid pET21ahF X-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-hF X-EGF1 before induction; and Lane 3 is the total protein of the *E. coli* after expressing the fusion protein RFP-hF X-EGF1 by induction. The arrowhead indicates the expressed fusion protein.

Figure 11:
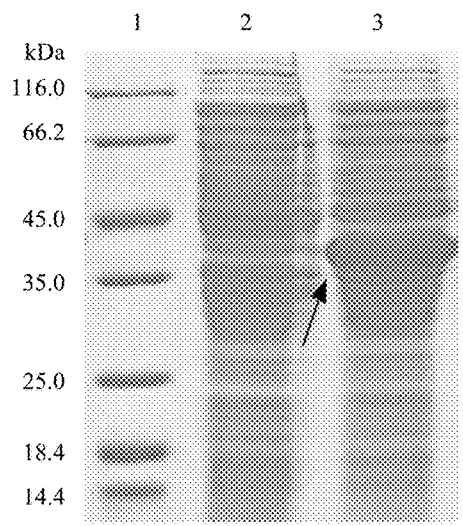

FIG. 11 is the SDS-PAGE analysis of inducible expression of the fusion protein RFP-hF X-EGF2 from the recombinant plasmid pET21ahF X-EGF2-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-hF X-EGF2 before induction; and Lane 3 is the total protein of the *E. coli* after expressing the fusion protein RFP-hF X-EGF2 by induction. The arrowhead indicates the expressed fusion protein.

Figure 12:
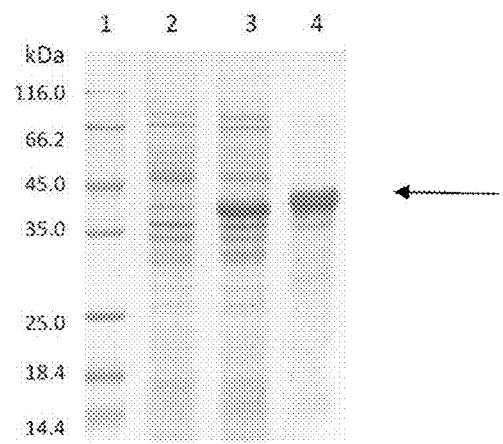

FIG. 12 is the SDS-PAGE analysis of inducible expression of the fusion protein RFP-Delta and Notch-like epidermal growth factor-related-EGF1 from the recombinant plasmid pET21ahDelta and Notch-like epidermal growth factor-related-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-Delta and Notch-like epidermal growth factor-related-EGF1 before induction; and Lane 3 is the total protein of the *E. coli* after expressing the fusion protein RFP-Delta and Notch-like epidermal growth factor-related-EGF1 by induction; and Lane 4 is the purified fusion protein RFP-Delta and Notch-like epidermal growth factor-related-EGF1. The arrowhead indicates the expressed fusion protein.

Figure 13:
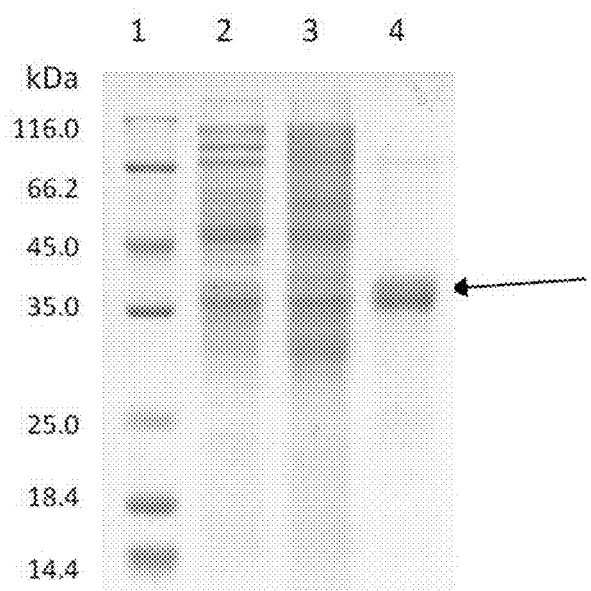

FIG. 13 is the SDS-PAGE analysis of inducible expression of the fusion protein RFP-Zonadhesin-EGF1 from the recombinant plasmid pET21ahZonadhesin-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-Zonadhesin-EGF1 before induction; and Lane 3 is the total protein of the *E. coli* after expressing the fusion protein RFP-Zonadhesin-EGF1 by induction; and Lane 4 is the purified fusion protein RFP-Zonadhesin-EGF1. The arrowhead indicates the expressed fusion protein.

Figure 14:
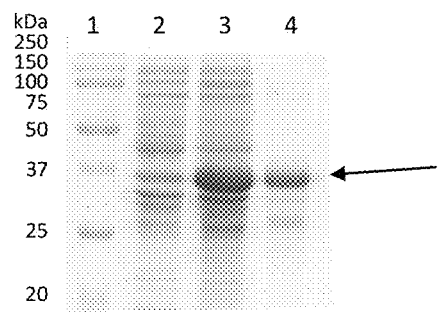

FIG. 14 is the SDS-PAGE analysis of inducible expression of the fusion protein RFP-EGF, latrophilin and seven transmembrane domain-containing protein 1-EGF2 from the recombinant plasmid pET21ahEGF-latrophilin and seven transmembrane domain-containing protein 1-EGF2-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-EGF, latrophilin and seven transmembrane domain-containing protein 1-EGF2 before induction; and Lane 3 is the total protein of the *E. coli* after expressing the fusion protein RFP-EGF, latrophilin and seven transmembrane domain-containing protein 1-EGF2 by induction; and Lane 4 is the purified fusion protein RFP-EGF, latrophilin and seven transmembrane domain-containing protein 1-EGF2. The arrowhead indicates the expressed fusion protein.

Figure 15:
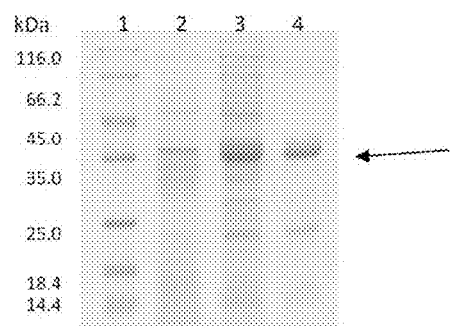

FIG. 15 is the SDS-PAGE analysis of inducible expression of the fusion protein RFP-Prostaglandin G/H synthase 1-EGF1 from the recombinant plasmid pET21ahProstaglandin G/H synthase 1-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-Prostaglandin G/H synthase 1-EGF1 before induction; and Lane 3 is the total protein of the *E. coli* after expressing the fusion protein RFP-Prostaglandin G/H synthase 1-EGF1 by induction; and Lane 4 is the purified fusion protein RFP-Prostaglandin G/H synthase 1-EGF1. The arrowhead indicates the expressed fusion protein.

Figure 16:
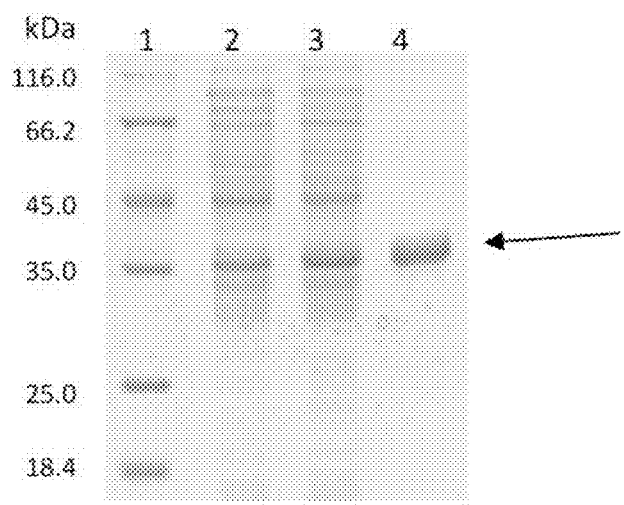

FIG. 16 is the SDS-PAGE analysis of inducible expression of the fusion protein RFP-Neurexin-1-EGF1 from the recombinant plasmid pET21ahNeurexin-1-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-Neurexin-1-EGF1 before induction; and Lane 3 is the total protein of the *E. coli* after expressing the fusion protein RFP-Neurexin-1-EGF1 by induction; and Lane 4 is the purified fusion protein RFP-Neurexin-1-EGF1. The arrowhead indicates the expressed fusion protein.

Figure 17:
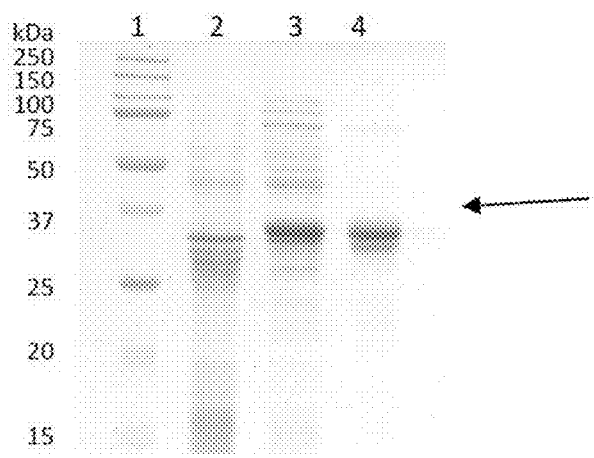

FIG. 17 is the SDS-PAGE analysis of inducible expression of the fusion protein RFP-EGF-containing fibulin-like extracellular matrix protein 1-EGF1 from the recombinant plasmid pET21ahEGF-containing fibulin-like extracellular matrix protein 1-EGF1-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-EGF-containing fibulin-like extracellular matrix protein 1-EGF1 before induction; and Lane 3 is the total protein of the *E. coli* after expressing the fusion protein RFP-EGF-containing fibulin-like extracellular matrix protein 1-EGF1 by induction; and Lane 4 is the purified fusion protein RFP-EGF-containing fibulin-like extracellular matrix protein 1-EGF1. The arrowhead indicates the expressed fusion protein.

Figure 18:
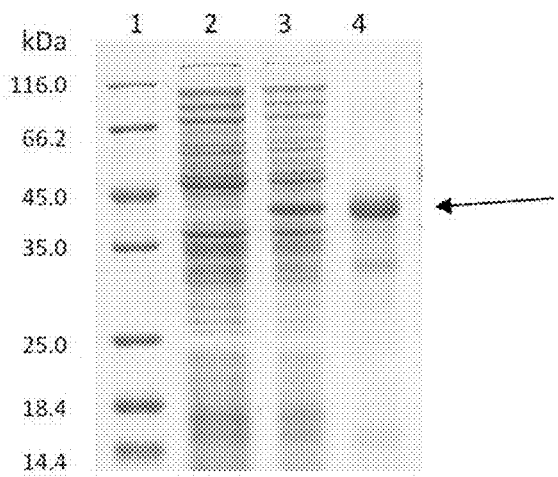

FIG. 18 is the SDS-PAGE analysis of inducible expression of the fusion protein RFP-Netrin-3-EGF1 from the recombinant plasmid pET21ahNetrin-3-EGF1-RFP in *E. coli* in Example 8, wherein Lane 1 is the protein molecular weight marker (Unst. Protein Marker, purchased from Thermo Scientific); Lane 2 is the total protein of the *E. coli* without expressing the fusion protein RFP-Netrin-3-EGF1 before induction; and Lane 3 is the total protein of the *E. coli* after expressing the fusion protein RFP-Netrin-3-EGF1 by induction; and Lane 4 is the purified fusion protein RFP-Netrin-3-EGF1. The arrowhead indicates the expressed fusion protein.

Figure 19:
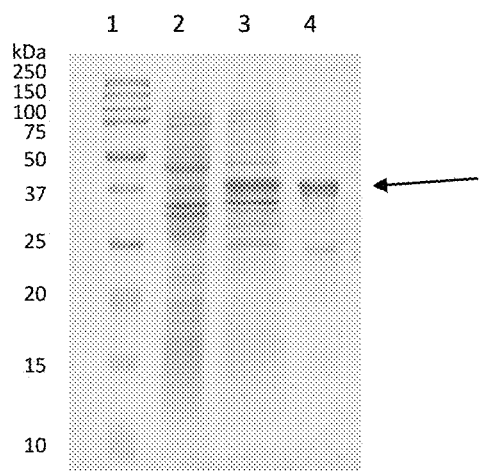

FIG. 19 is the SDS-PAGE analysis of inducible expression of the fusion protein RFP-Putative EGF-like module-containing mucin-like hormone receptor-like 4-EGF2 from the recombinant plasmid pET21ahPutative EGF-like module-containing mucin-like hormone receptor-like 4-EGF2-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Putative EGF-like module-containing mucin-like hormone receptor-like 4-EGF2 before induction; and Lane 3 is the total protein of the *E. coli* after expressing the fusion protein RFP-Putative EGF-like module-containing mucin-like hormone receptor-like 4-EGF2 by induction; and Lane 4 is the purified fusion protein RFP-Putative EGF-like module-containing mucin-like hormone receptor-like 4-EGF2. The arrowhead indicates the expressed fusion protein.

Figure 20:
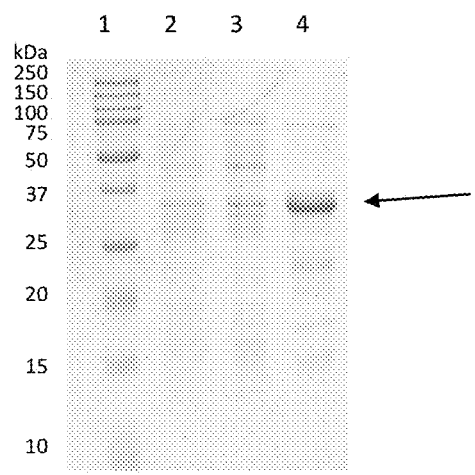

FIG. 20 is the SDS-PAGE analysis of inducible expression of the fusion protein RFP-Protransforming growth factor alpha-EGF1 from the recombinant plasmid pET21ahProtransforming growth factor alpha-EGF1-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Protransforming growth factor alpha-EGF1 before induction; and Lane 3 is the total protein of the *E. coli* after expressing the fusion protein RFP-Protransforming growth factor alpha-EGF1 by induction; and Lane 4 is the purified fusion protein RFP-Protransforming growth factor alpha-EGF1. The arrowhead indicates the expressed fusion protein.

Figure 21:
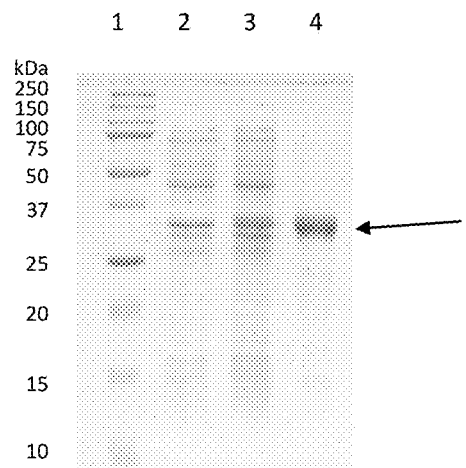

FIG. 21 is the SDS-PAGE analysis of inducible expression of the fusion protein RFP-Delta-like protein 4-EGF2 from the recombinant plasmid pET21ahDelta-like protein 4-EGF2-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Delta-like protein 4-EGF2 before induction; and Lane 3 is the total protein of the *E. coli* after expressing the fusion protein RFP-Delta-like protein 4-EGF2 by induction; and Lane 4 is the purified fusion protein RFP-Delta-like protein 4-EGF2. The arrowhead indicates the expressed fusion protein.

Figure 22:
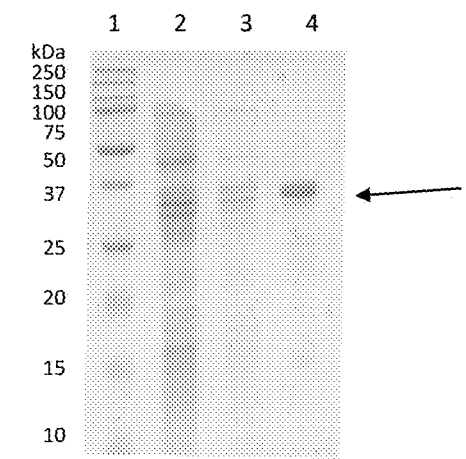

FIG. 22 is the SDS-PAGE analysis of inducible expression of the fusion protein RFP-Nidogen-1-EGF1 from the recombinant plasmid pET21ahNidogen-1-EGF1-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Nidogen-1-EGF1 before induction; and Lane 3 is the total protein of the *E. coli* after expressing the fusion protein RFP-Nidogen-1-EGF1 by induction; and Lane 4 is the purified fusion protein RFP-Nidogen-1-EGF1. The arrowhead indicates the expressed fusion protein.

Figure 23:
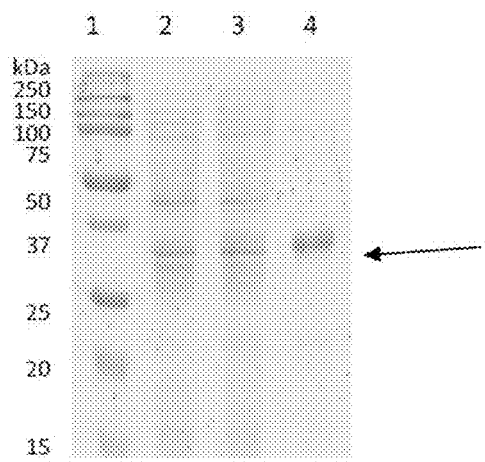

FIG. 23 is the SDS-PAGE analysis of inducible expression of the fusion protein RFP-Uromodulin-like 1-EGF3 from the recombinant plasmid pET21ahNidogen-1-EGF1-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Uromodulin-like 1-EGF3 before induction; and Lane 3 is the total protein of the *E. coli* after expressing the fusion protein RFP-Uromodulin-like 1-EGF3 by induction; and Lane 4 is the purified fusion protein RFP-Uromodulin-like 1-EGF3. The arrowhead indicates the expressed fusion protein.

Figure 24:
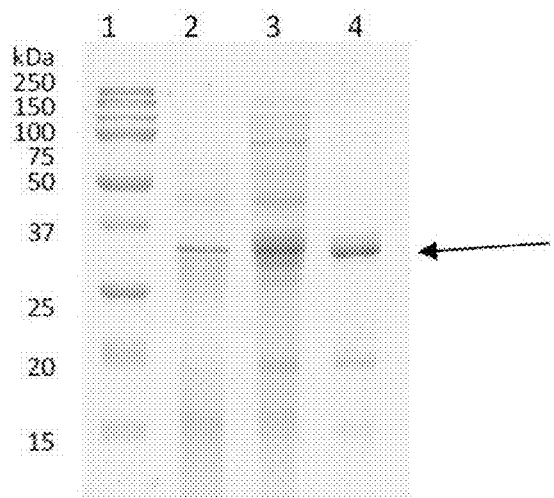

FIG. 24 is the SDS-PAGE analysis of inducible expression of the fusion protein RFP-Sushi, von Willebrand factor type A-EGF and pentraxin domain-containing protein 1-EGF2 from the recombinant plasmid pET21 ahSushi, von Willebrand factor type A-EGF and pentraxin domain-containing protein 1-EGF2-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Sushi, von Willebrand factor type A-EGF and pentraxin domain-containing protein 1-EGF2 before induction; and Lane 3 is the total protein of the *E. coli* after expressing the fusion protein RFP-Sushi, von Willebrand factor type A-EGF and pentraxin domain-containing protein 1-EGF2 by induction; and Lane 4 is the purified fusion protein RFP-Sushi, von Willebrand factor type A-EGF and pentraxin domain-containing protein 1-EGF2. The arrowhead indicates the expressed fusion protein.

Figure 25:
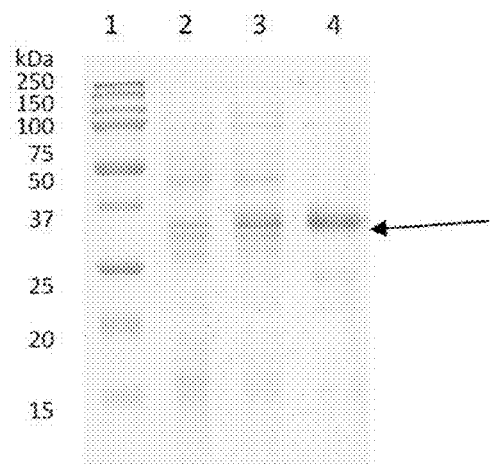

FIG. 25 is the SDS-PAGE analysis of inducible expression of the fusion protein RFP-Protocadherin Fat 2-EGF1 from the recombinant plasmid pET21ahProtocadherin Fat 2-EGF1-RFP in *E. coli* in Example 8, wherein Lane 1 is the protein molecular weight marker (Precision Plus Protein Standards, purchased from BIO-RAD); Lane 2 is the total protein of the *E. coli* without expressing the fusion protein RFP-Protocadherin Fat 2-EGF1 before induction; and Lane 3 is the total protein of the *E. coli* after expressing the fusion protein RFP-Protocadherin Fat 2-EGF1 by induction; and Lane 4 is the purified fusion protein RFP-Protocadherin Fat 2-EGF1. The arrowhead indicates the expressed fusion protein.

Figure 26:
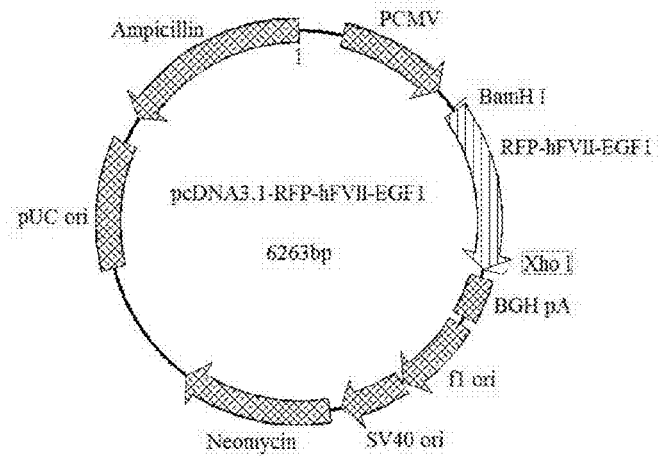

FIG. 26 is the schematic representation of the recombinant eukaryotic plasmid pcDNA3.1-RFP-hF VII-EGF1 in Example 9, wherein the counterclockwise sequence is the forward gene fragment and the clockwise one is the reverse gene fragment.

Figure 27:
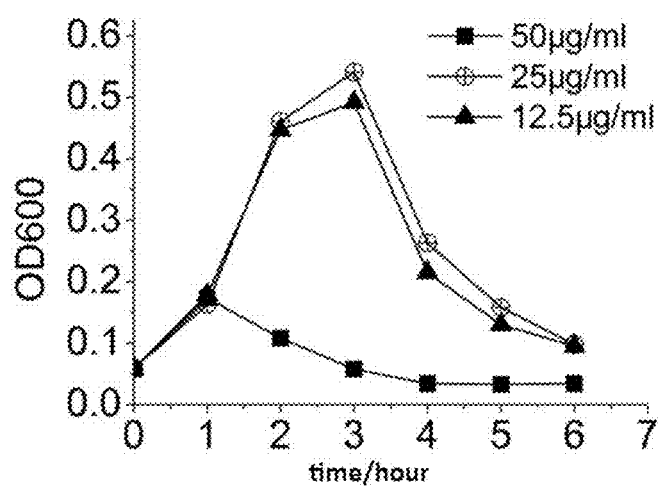

FIG. 27 is the growth curve of *E. coli* DH5α treated with the recombinant protein hF VII-EGF1 in Example 14.

Figure 28:
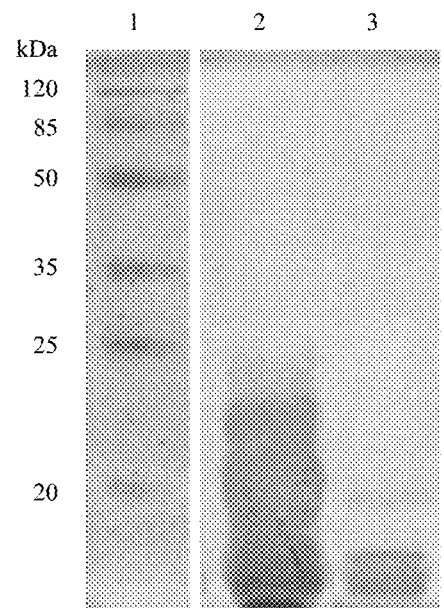

FIG. 28 is a silver staining image for hydrolysis of *E. coli* EH100 LPS by the recombinant protein hF VII-EGF1 in Example 17, in which Lane 1 is the prestained protein marker; Lane 2 is the *E. coli* EH100 LPS untreated; and Lane 3 is the *E. coli* EH100 LPS treated with hF VII-EGF1.

DETAILED DESCRIPTION

The present invention will be further illustrated below in connection with the Examples. In the Examples described hereinafter, where the particular experiment conditions are not otherwise noted, they will follow the conventional conditions well known to the person of skill in the art, such as the conditions and experimental steps described in Molecular Cloning: A Laboratory Manual, Sambrook et al (Ed.), New York, Cold Spring Harbor Laboratory Press, 1989, An Conventional Manual for Laboratory Animals (National Center for Standard Laboratory Animals, November, 2004), and a Manual of Basic Technique, 5$^{th}$ Edition (John Wiley & Sons, Inc., 2005), or follow the conditions and experimental steps recommended by the manufacture. The particular experimental methods in the Examples are exemplified by the protein hF VH-EGF1, and the experimental methods for other human-originated. EGF domain proteins (PRT2 to PRT1498 in Table 1) are performed with reference to those for the protein hF VII-EGF1. Nucleotide sequences for the expressed proteins of interest can be obtained from the databases on the web www.uniprot.org/or www.ncbi.nlm.nih.gov/).

Example 1: Acquisition of the Gene for the Fusion Protein RFP-hF VII-EGF1 with a Red Fluorescent Protein (RFP) Tag 1. The primers for PCR amplification as shown below were synthesized (by Invitrogen Biological Technology Co. Ltd.):

```
Primer 1:
                                    SEQ ID NO: 1499
5'-TAACATATGGTGAGCAAGGGCGAGGAGGATA-3'
     Nde I Primer 2:
                                    SEQ ID NO: 1500
5'-GAAAACCTGTACTTCCAGGGTCAATTCGAAGATGGGGACCAGTGTGC
CTC-3'
                       Bsp119 I
The enzymatic cleavage site for
the recombinant protease (rTEV)

Primer 3:
                                    SEQ ID NO: 1501
5'-CCTGGAAGTACAGGTTTTCCTTGTACAGCTCGTC-3'

Primer 4:
                                    SEQ ID NO: 1502
5'-TATGGATCCTTACTCACAGTTCCGGCCCTCGAA-3'
     BamH I
```

2. Obtaining the coding sequences for hF VII-EGF1 and RFP by PCR amplification (1) Obtaining the DNA Fragment Encoding for hF VII-EGF1

The PCR amplification was performed with Primers 2 and 4 using a plasmid comprising the hF VII CDS region (FulenGen Co. Ltd., Guangzhou) as the template. A BamH I restriction site introduced into the sequence of Primer 4, and an enzymatic cleavage site for the recombinant tobacco mosaic virus proteinase (rTEV) and a restriction site for Bsp119 I were introduced into the sequence of Primer 2, in order to facilitate replacement with the expressible sequences for expressing other human-originated EGF domain proteins (PRT2 to PRT1498 in Table 1). The PCR reaction system (50 μL) was as follows:

| | |
|---|---:|
| Deionized water: | 31.5 μL |
| 5 × Reaction buffer: | 10 μL |
| dNTP Mix: | 4 μL |

-continued

| | |
|---|---|
| Primer 2 (10 mM): | 1 µL |
| Primer 4 (10 mM): | 1 µL |
| Plasmid comprising the hF VII CDS region (100 ng/µL) | 2 µL |
| PrimeStar DNA polymerase: | 0.5 µL |

The reaction condition for the PCR amplification was set with reference to the instruction of PrimeStar DNA polymerase (purchased from Takara): pre-denaturation at 98° C. for 2 min, 30 cycles of denaturation at 98° C. for 10 sec, annealing at 55° C. for 15 sec, and elongation at 72° C. for 30 sec, followed by elongation at 72° C. for 4 min.

Figure 1:
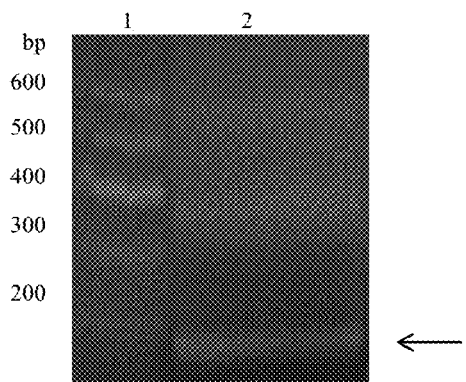

The amplified products were analyzed with 2% agarose gel electrophoresis, the DNA fragments comprising the coding sequence for hF VII-EGF1 was obtained (see FIG. 1), and the fragments of interest was recovered according to the instruction of a gel recovery kit (purchased from Omega).

(2) Obtaining the DNA Fragment Encoding for the Protein Tag RFP

The PCR amplification was performed with Primers 1 and 3 using a plasmid comprising the coding sequence of the gene for the RFP protein (purchased from Takara) as the template. An Nde I restriction site was introduced into the sequence of Primer 1. The reaction system was set up with reference to that for obtaining the DNA fragment encoding for hF VII-EGF1.

The reaction condition for the PCR amplification was set up with reference to the instruction of PrimeStar DNA polymerase: pre-denaturation at 98° C. for 2 min, 30 cycles of denaturation at 98° C. for 10 sec, annealing at 55° C. for 15 sec, and elongation at 72° C. for 1 min, followed by elongation at 72° C. for 4 min.

The amplified products were analyzed with 2% agarose gel electrophoresis, the DNA fragment comprising the coding sequence for RFP was obtained, and the fragment of interest was recovered according to the instruction of a gel recovery kit (purchased from Omega).

3. Amplification of the gene encoding for the fusion protein RFP-hF VII-EGF1 by overlapping PCR.

A overlapping PCR amplification was performed with Primers 1 and 4 using the DNA fragment obtained from the two PCR amplifications mentioned above as templates, yielding a fusion gene fragment RFP-hF VII-EGF1 which comprises a coding sequence for the RFP-TEV enzymatic cleavage site and the human coagulation factor VII-EGF1 protein. The PCR reaction system (50 µL) was as follows:

| | |
|---|---|
| Deionized water: | 31.5 µL |
| 5 × Reaction buffer: | 10 µL |
| dNTP Mix: | 4 µL |
| Primer 1: | 1 µL |
| Primer 4: | 1 µL |
| the hF VII-EGF1-encoding DNA fragment obtained by the first PCR amplification (100 ng/µL): | 1 µL |
| the RFP-encoding DNA fragment obtained by the second PCR amplification (100 ng/µL): | 1 µL |
| PrimeStar DNA polymerase: | 0.5 µL |

The reaction condition for the PCR amplification was set up with reference to the instruction of PrimeStar DNA polymerase: pre-denaturation at 98° C. for 2 min, 30 cycles of denaturation at 98° C. for 10 sec, annealing at 55° C. for 15 sec, and elongation at 72° C. for 1.5 min, followed by elongation at 72° C. for 4 min.

Figure 2:
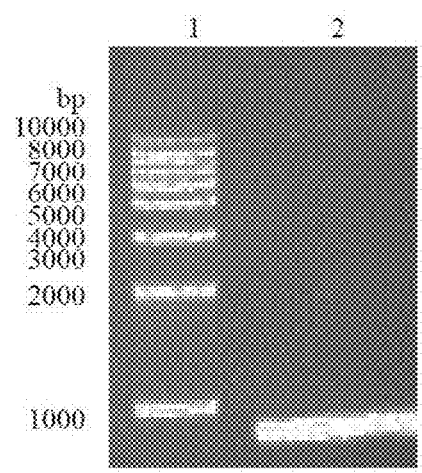
FIG. 2 is the electrophoregram of PCR amplification of the gene sequence encoding the fusion protein RFP-hF VII-EGF1 in Example 1, wherein Lane 1 is the DNA molecular weight marker (1 kb Marker, purchased from TIANGEN BIOTECH Co. Ltd.) and Lane 2 is PCR amplification of the sequence encoding RFP-hF VII-EGF1.

The amplified products were analyzed with 2% agarose gel electrophoresis, the fragment comprising the sequence encoding for RFP-hF VII-EGF1 was obtained (see FIG. 2), and the fragment of interest was recovered according to the instruction of a gel recovery kit (purchased from Omega).

Example 2: Construction of the Recombinant Prokaryotic Plasmid for Expressing the Fusion Protein RFP-hF VII-EGF1

1. Pre-Treatment of the RFP-hF VII-EGF1 gene and the prokaryotic expression vector pET19b The RFP-hF VII-EGF1 gene fragment obtained in Example 1 and the prokaryotic expression vector pET19b (the product from Novagen, the plasmid had been modified to carry a gene encoding for a red fluorescent protein) were individually double digested with the restriction endonucleases Nde I and BamH I (both purchased from TaKaRa or Fermentas) at 37° C. overnight, and the reaction systems were established as follows:

| Reagent | RFP-hF VII-EGF1 (µL) | pET19b (µL) |
|---|---|---|
| DNA | 20 | 20 |
| Nde I | 1 | 1 |
| BamH I/Xho I | 1 | 1 |
| 10 × Buffer | 6 | 6 |
| Double distilled water | 2 | 2 |
| Total volume | 30 | 30 |

After completion of the double digestion, the reaction products were analyzed with 1% agarose gel electrophoresis and the fragments of interest were recovered under the ultraviolet lamp of a gel imaging system according to the instruction of a gel recovery kit (purchased from Omega).

2. Ligation of the RFP-hF VII-EGF1 gene to the prokaryotic expression vector pET19b and transformation (1) The gene fragment RFP-hF VII-EGF1 and the prokaryotic vector fragment obtained in the above steps were quantified approximately and then subjected to ligation according to the ligation reaction principle where a ratio of the molecule number of the gene fragment to the molecule number of the prokaryotic vector is 3:1. The ligation reaction system was set up as follows:

| Reagent | Volume (µL) |
|---|---|
| pET19b DNA | 1.5 |
| RFP-hF VII-EGF1 | 7 |
| T4 ligase | 0.5 |
| 10 × buffer | 1 |
| Total volume | 10 |

Figure 3:
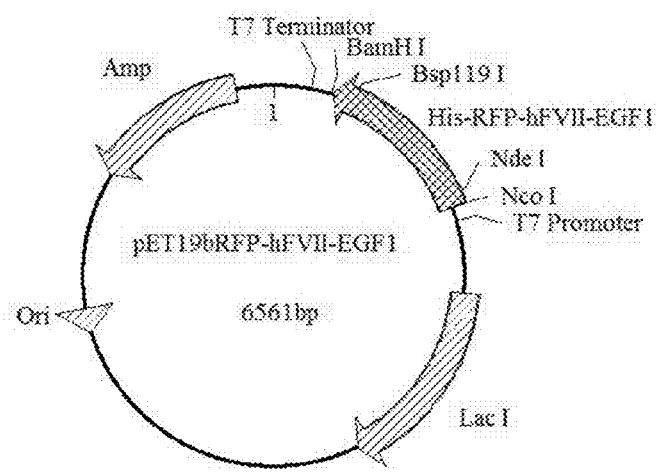
FIG. 3 is the schematic representation of the recombinant prokaryotic plasmid pET19bRFP-hF VII-EGF1 in Example 2, wherein the counterclockwise sequence is the forward gene fragment and the clockwise one is the reverse gene fragment.

(2) The entire ligation reaction was proceeded at 16° C. overnight treated with T4 DNA ligase (purchased from Fermentas). The gene fragment RFP-hF VII-EGF1 amplified above was inserted into the prokaryotic expression vector pET19b and the construction of the recombinant prokaryotic plasmid was schematically shown in FIG. 3.

(3) The ligation product was transformed into the competent cells (prepared according to Molecular Cloning: a Laboratory Manual) of E. coli Top10 (purchased from Invitrogen company). The main steps of the procedure for transforming the ligation product were as follows:

1) 5 µl of the ligation product was pipetted into 100 µL of the competent cells of *E. coli* Top10 placed in a 1.5 mL Eppendorf tube, and the negative control is 100 µl of the competent cells of *E. coli* Top10 placed in a 1.5 mL Eppendorf tube;

2) the tubes were placed on ice for 30 min;

3) the competent cells were shocked in a metal bath at 42° C. for 90 s;

4) the tubes were transferred rapidly into an ice-bath to be cooled for 2 min;

5) 900 µL of SOC medium (10 g peptone, 5 g yeast extract, 0.5 g NaCl, 0.186 g KCl, 0.95 g $MgCl_2$, dissolved with $ddH_2O$ and made up to a volume of 980 mL, autoclaved, cooled to room temperature and then 20 mL of sterile 20% aqueous glucose solution was added) was added, and placed on ice;

6) the tubes were incubated at 37° C. for 1 h with shaking at 180 rpm;

7) the bacterial suspension was centrifuged at 4000×g for 3 min, and the excessive medium was removed except 200 µL supernatant was kept. 200 µL of the remaining supernatant was used to resuspend the bacteria;

8) the resuspended transformants were plated uniformly onto the solid LB medium containing 0.1 g/mL of ampicillin and incubated in a constant-temperature incubator at 37° C. overnight.

3. Identification of the recombinant plasmid

The single clone of the transformed *E. coli* Top 10 mentioned above was picked, cultured in a small quantity and subjected to plasmid extraction with a plasmid extraction kit (purchased from OMEGA), followed by double digestion set forth in the steps of the present Example step 1. The result of the double digested product resolved by gel-electrophoresis is shown in FIG. 4. The sizes of the two bands produced by the enzymatic digestion are consistent with those of the expected products, demonstrating the success of construction of the plasmid of interest.

The plasmids which had been identified by double digestion to be correct ones were send to Beijing Genomics Institute for sequencing of the inserted fusion gene fragment. Finally, the recombinant prokaryotic plasmid comprising the RFP-hF VII-EGF1 gene with the correct sequencing result was designated as pET19bRFP-hF VII-EGF1.

Example 3: Obtaining the Fusion Genes for the RFP Fusion Proteins of Other Human-Originated EGF Domain Proteins (PRT2 to PRT1498 in Table 1) with a Red Fluorescent Protein (RFP) Tag Since all of the expressed sequences of the human-originated EGF domain proteins (PRT1 to PRT1498 in Table 1) set forth in the present invention have been published, the expressible nucleotide sequences can be obtained directly by artificial synthesis. In this Example, synthesis of the gene fragments was outsourced respectively to the commercial companies such as Beijing Genomics Institute, GENEWIZ (Beijing) Co. Ltd., etc. When synthesized, a Bsp119 I restriction site was introduced upstream of all these gene fragments, to facilitated construction of prokaryotic expression plasmids. Electrophoresis of an overlapping PCR amplification of the gene sequence encoding for the fusion protein RFP-hF VII-EGF2 is shown in FIG. 5.

Example 4: Construction of the Prokaryotic Recombinant Plasmids for Expression of the RFP Fusion Proteins of Other Human-Originated EGF Domain Proteins (PRT2 to PRT1498 in Table 1)

1. Pre-Treatment of the genes and the prokaryotic expression vector pET19b

The gene fragments for other human-originated EGF domain proteins and the recombinant plasmid pET19bRFP-hF VII-EGF1 constructed in Example 2 were double digested with the restriction endonucleases Bsp119 I and BamH I (both purchased from TaKaRa or Fermentas) at 37° C. overnight.

2. Other steps for ligation of the expression genes to the plasmid and identification were performed with reference to Example 2.

Example 5: Expression from the Recombinant Plasmid pET19bRFP-hF VII-EGF1

1. The recombinant plasmid pET19bRFP-hF VII-EGF1 constructed in Example 2 was transformed into *E. coli* BL21(DE3) (purchased from Invitrogen); the single clone was picked into the LB medium containing 0.1 g/mL ampicillin and incubated at 37° C. with shaking at 185 rpm to $OD_{600}$ of about 0.6, and 1 mL of the bacterial suspension was taken and frozen at −20° C. Then, IPTG (isopropyl-β-D-thiogalactoside) was added to the remaining bacterial suspension at a final concentration of 0.8 mM. The incubation proceeded for 6 h and 1 mL of the bacterial suspension was taken and frozen at −20° C.

2. The above-mentioned samples before and after IPTG induction were assayed by SDS-PAGE electrophoresis with 5% of the stacking gel and 12% of the separating gel, in order to analyze expression of the protein of interest (see FIG. 6). The result indicated that the protein was expressed normally.

Example 6: Purification of the Fusion Protein RFP-hF VII-EGF1 by Affinity Chromatography 1. The bacterium RFP-hF VII-EGF1-pET19bBL21-(DE3) was cultured on a large scale according to the method in Example 5, induced by addition of IPTG, and cultured overnight at 18° C., with shaking at 175 rpm.

2. The above-mentioned bacterial suspension was centrifuged at 4000×g for 3 min to collect the bacteria. The bacterial pellet was washed by resuspension in the EW buffer (20 mM sodium phosphate, 500 mM NaCl, 1 mM DTT, 0.1 mM PMSF, pH 7.4). The bacterial suspension was centrifuged at 4000×g for 3 min, and the supernatant was discarded. Again, the bacterial pellet was resuspended with 10 mL of the EW buffer.

3. The bacteria were disrupted by sonication (power: 300 W; duration for sonication: 10 s; interval: 10 s; total time for sonication: 3 min; performed in ice-bath). After completion of the sonication, the bacterial suspension was centrifuged at 48,400×g at 4° C. for 1 h. The supernatant was collected and placed on ice.

4. The chromatographic column was preloaded according to the instruction of $Co^{2+}$ purification system (Talon Metal Affinity Resin, Clontech company product), and the sample was loaded. The column was washed twice with 10 mL EW buffer and the protein impurities were washed out with 10 mM imidazole solution. Finally, the protein was eluted with 100 mM imidazole.

5. The eluent comprising the proteins of interest was ultrafiltrated with Tris-Cl buffer (pH 7.4), for buffer exchange and concentration. After ultrafiltration, the high concentration of the fusion protein RFP-hF VII-EGF1 can be obtained. It was shown by protein quantitation that about 15 mg of the proteins of interest with more than 95% of purity can be obtained per liter of the expressing bacterium suspension.

Example 7: Enzymatic Cleavage of the Fusion Protein RFP-hF VII-EGF1 and Purification of the Recombination Protein hF VII-EGF1

1. The Reasin Ni column (Ni column purchased from GE) was treated as follows: 200 µL of the Ni column mix was pipetted into a 1.5 mL EP tube (AxyGEN) and centrifuged at 700×g for 2 min, the preservative solution for the Reasin Ni column (20% ethanol) was discarded, then, the Ni column was washed twice with 1 mL deionised water, followed by equilibration of the Ni column with 1 mL binding buffer (0.5 M NaCl, 20 mM phosphate buffer, pH 7.4).

2. 450 µA of 3 µg/µL fusion proteins were mixed individually with the treated Ni column to homogeneity after equilibration of the Ni column, co-incubated at 4° C. for 1 h on a vertical rotary mixer.

3. After completion of incubation, the mixture was centrifuged at 4° C. at 700×g for 3 min After completion of centrifugation, Ni beads obtained by centrifugation were washed twice with 500 µA of binding buffer. Ni beads were collected after completion of washing.

4. The beads were resuspended with 423 µl of binding buffer. After resuspending and mixing well, the resultant mixture was subjected to cleavage at 4° C. with the rTEV proteinase (purchased from Shanghai Sangon). The mixture was placed on a vertical rotary mixer overnight with the time of period limited to 10 h. After completion of the enzymatic cleavage, the mixture was centrifuged at 700×g at 4° C. for 5 min. After completion of centrifugation, the supernatant was collected as the recombination protein hF VII-EGF1. The picture of Tricien gel analysis for identifying the recombination protein hF VII-EGF1 obtained after enzymatic cleavage of the fusion protein RFP-hF VII-EGF1 with rTEV is seen in FIG. 7. The enzymatic cleavage system was set up as follows:

| 20 × TEV buffer | 22.5 µL |
| 0.1M DTT | 1.5 µL |
| Protein beads | 420 µL |
| rTEV enzyme | 3 µL |

Example 8: Prokaryotic Expression of the Other Recombination Human-Originated EGF Domain Proteins (PRT2 to PRT1498 in Table 1) and Purification of the Same The other human-originated EGF domain proteins (PRT2 to PRT1498 in Table 1) can be expressed prokaryotically and then purified with the same methods as those in Examples 5-7. Partial profiles are shown in FIGS. 6 to 25.

Example 9: Construction of the Recombinant Eukaryotic Plasmid for Expressing the Fusion Protein RFP-hF VII-EGF1

1. The primers for PCR amplification as shown below were synthesized (by Invitrogen Biological Technology Co. Ltd.):

```
Primer 1:
                                    SEQ ID NO: 1503
TAAGGATCCTGCAGAGATTTCATCATGCATCATCATCAT
   BamH I    Kozak Primer 2:
                                    SEQ ID NO: 1504
TATCTCGAGTTACTCACAGTTCCGG
   Xho I
```

2. PCR Amplification System

The PCR amplification was performed with Primers 1 and 2 using the plasmid pET19bRFP-hF VII-EGF1 constructed in Example 2 as the template. A BamH I restriction enzyme cutting site and a Kozak sequence were introduced into the sequence of Primer 1, and an Xho I restriction enzyme cutting site was introduced into the sequence of Primer 2. The PCR reaction was performed with reference to Example 1.

3. Construction of the recombinant plasmid for eukaryotic expression of the fusion protein RFP-hF VII-EGF1

The cloned gene fragment RFP-hF VII-EGF1 and the eukaryotic expression vector pcDNA3.1 (+) (the product from Novagen) were double digested with the restriction endonucleases BamH I and Xho I (both purchased from TaKaRa or Fermentas), and the reaction systems were set up with reference to Example 2. The steps for ligating the gene fragment to the eukaryotic expression vector and for transforming and identifying the recombinant plasmid were performed with reference to Example 2.

Finally, the recombinant plasmid comprising the RFP-hF VII-EGF1 gene with the correct sequencing result was designated as pcDNA3.1-RFP-hF VII-EGF1. The plasmid map of the recombinant plasmid is seen in FIG. 26.

Example 10: Construction of a Stable Cell Line for Expressing the Fusion Protein RFP-hF VII-EGF1

1. Cell preparation

DG44 cells (purchased from ATCC) were cultured in the α-MEM complete culture medium (containing L-glutamine, ribonucleic acid and deoxyribonucleic acid, purchased from Hiclony) supplemented with 10% FBS (fetal bovine serum, purchased from Hiclony). On the day before transfection, DG44 cells were seeded in a 6-well plate at 4×10$^5$ cells/mL with 2 mL per well.

2. Cell transfection

Cells were transfected by using liposome method following the instruction of Lipofectamine™ 2000 kit (purchased from Invitrogen). The detailed steps are as follows:

1) The cell culture medium was replaced with serum-free α-MEM medium, 2 mL/well.

2) 4.0 µg of the recombinant eukaryotic expression plasmid pcDNA3.1-RFP-hF VII-EGF1 constructed in Example 9 was mixed with 250 µL Opti-MEM, while 10 µL of Lipofectamine™ 2000 was mixed with 250 µL of Opti-MEM and incubated for 5 min.

3) The two solutions were mixed well and incubated for 20 min. The liposome complexes were added into the well with cells, gently mixed, placed into an incubator and cultured at 37° C.

4) After 5 h, the medium was replaced with the α-MEM complete culture medium supplemented with 10% FBS.

3. Screening and expanding of the positive cell clones

After 24 h of transfection with the recombinant plasmid, the cells were transferred into 100 mm petri dishes at a ratio of 1:2000. G418 (purchased from Gibco) was added at a final concentration of 800 μg/mL for screening. Cells transfected with an empty vector or not transfected were used as controls. After 15 days, the single clones were picked into and cultured in 24-well plates, and sequentially transferred into 6-well plates and into 100 mm petri-dishes for expanding culture once cellular confluence was reached. When the cell confluency was 90%, cells were frozen at a rate of 1:4 in FBS with 10% DMSO (purchased from Gibco).

4. Identification of the positive cell clones

The picked positive cell clones were identified by the genomic PCR and RT-PCR. The fragment of interest could be amplified by both of the techniques, which demonstrated that the fusion gene has been integrated into the genome of the cell and a functional mRNA is transcribed. The stable cell line obtained was designated as DG44-RFP-hF VII-EGF1.

Example 11: Collection of the Eukaryotically Expressed Fusion Protein RFP-hF VII-EGF1

1. The DG44-RFP-hF VII-EGF1 cells were cultured in the α-MEM complete culture medium containing 10% FBS supplemented with 400 μg/mL G418, and passaged into 10 plates.

2. When the cell confluency in each plate reached to more than 90%, the α-MEM complete culture medium containing 10% FBS was replaced with CHO serum-free medium, and supplemented with Vitamin K (Sigma) to a final concentration of 1 μg/mL.

3. After 3 days of cultivation, the cellular pellet was collected and disrupted. Then, the supernatant was obtained by centrifugation, purified by cobalt ion affinity chromatography and identified by SDS-PAGE plus Western Blot. The steps were referred to those in Example 6.

Example 12: Enzymatic Cleavage of the Eukaryotically Expressed Fusion Protein RFP-hF VII-EGF1 and Recovery of hF VII-EGF1

The experimental method followed that in Example 7.

Example 13: Eukaryotic Expression of the Other Human-Originated EGF Domain Proteins (PRT2 to PRT1498 in Table 1) and Purification of the Same According to the methods of Examples 9-10, the eukaryotic expression plasmids for the RFP fusion proteins of other human-originated EGF domain proteins (PRT2 to PRT1498 in Table 1) were constructed and the cell lines stably expressing these fusion proteins were established.

According to the methods of Examples 11-12, the eukaryotically expressed fusion proteins were collected and subjected to enzymatic cleavage, and the other human-originated EGF domain proteins (PRT2 to PRT1498 in Table 1) were finally obtained.

Example 14: Determination of the Antibacterial Activity of the Recombinant Protein hF VII-EGF1

1. *E. coli* DH5α was exemplified. *E. coli* DH5α was streaked and cultured on LB solid medium. Then, a typical clone was picked and inoculated into common LB liquid medium, cultured at 37° C. with shaking at 185 rpm until the logarithmic growth phase was reached ($OD_{600}$ of about 0.5). The bacterial culture was centrifuged at 4000×g for 3 min, the supernatant was discarded, and the thalli were resuspended with fresh LB medium.

2. The above-mentioned bacterial suspension was diluted and inoculated into a 96-well plate with the total volume of 100 μL per well and a bacterial count of $5 \times 10^5$ CFU/mL.

3. The recombinant protein hF VII-EGF1 was added to the above-mentioned wells with the final protein concentration in the well of the highest protein concentration being 50 μg/mL. Basing on this final concentration, a two-fold serial dilution was performed till a protein concentration gradient consisting of 50, 25, and 12.5 μg/mL was set up. Three parallel wells were set up for each concentration in the gradient.

4. The above-mentioned 96-well plate was placed and cultured at 37° C. in shaking incubator shaking at 175 rpm. Samples were taken every 30 min, the absorbance values were determined at 600 nm wavelength under a ultra violet spectrophotometer, and an inhibition curve was plotted. Judgement on MIC: After 8 h of cultivation, the growth was observed with naked eyes or judged under the ultra violet spectrophotometer at a wavelength of 600 nm. The minimal inhibitory concentration MIC is defined as the lowest concentration of the recombinant protein at which there is no growth of the bacteria.

The growth curve of *E. coli* DH5α treated with the recombinant protein hF VII-EGF1 is seen in FIG. 27. The curve indicates that the recombinant protein hF VII-EGF1 exhibits a significant inhibitory effect on the growth of *E. coli* DH5α, with the MIC being 12.5 μg/mL.

Example 15: Determination of Antibacterial Activities of the Other Human-Originated EGF Domain Proteins (PRT2 to PRT1498 in Table 1)

According to the experimental procedures in Example 14, the minimal inhibitory concentrations (MIC, μg/mL) of the other human-originated EGF domain proteins (PRT2 to PRT1498 in Table 1) for *E. coli* DH5α were determined. The results are shown in Table 2:

TABLE 2

| MIC (μg/mL) of the human-originated EGF domain proteins against *E. coli* DH5α ||
| Protein | MIC |
| --- | --- |
| PRT1 | 12.5 |
| PRT2 | 25 |
| PRT3 | 12.5 |
| PRT4 | 25 |
| PRT5 | 12.5 |
| PRT6 | 50 |
| PRT7 | 12.5 |
| PRT8 | 25 |
| PRT9 | 12.5 |
| PRT10 | 25 |
| PRT11 | 12.5 |
| PRT12 | 12.5 |
| PRT13 | 25 |
| PRT14 | 25 |
| PRT15 | 25 |
| PRT16 | 12.5 |
| PRT17 | 12.5 |
| PRT18 | 12.5 |
| PRT19 | 25 |
| PRT20 | 12.5 |

TABLE 2-continued

MIC (μg/mL) of the human-originated EGF domain proteins against *E. coli* DH5α

| Protein | MIC |
|---|---|
| PRT21 | 25 |
| PRT22 | 50 |
| PRT23 | 12.5 |
| PRT24 | 12.5 |
| PRT25 | 50 |
| PRT26 | 25 |
| PRT27 | 12.5 |
| PRT28 | 50 |
| PRT29 | 25 |
| PRT30 | 25 |
| PRT31 | 25 |
| PRT32 | 12.5 |
| PRT33 | 12.5 |
| PRT34 | 100 |
| PRT35 | 12.5 |
| PRT36 | 12.5 |
| PRT37 | 25 |
| PRT38 | 50 |
| PRT39 | 50 |
| PRT40 | 25 |
| PRT41 | 25 |
| PRT42 | 25 |
| PRT43 | 12.5 |
| PRT44 | 12.5 |
| PRT45 | 50 |
| PRT46 | 25 |
| PRT47 | 12.5 |
| PRT48 | 12.5 |
| PRT49 | 12.5 |
| PRT50 | 25 |
| PRT51 | 25 |
| PRT52 | 12.5 |
| PRT53 | 12.5 |
| PRT54 | 12.5 |
| PRT55 | 25 |
| PRT56 | 25 |
| PRT57 | 12.5 |
| PRT58 | 12.5 |
| PRT59 | 25 |
| PRT60 | 12.5 |
| PRT61 | 12.5 |
| PRT62 | 12.5 |
| PRT63 | 12.5 |
| PRT64 | 12.5 |
| PRT65 | 25 |
| PRT66 | 12.5 |
| PRT67 | 12.5 |
| PRT68 | 12.5 |
| PRT69 | 12.5 |
| PRT70 | 12.5 |
| PRT71 | 50 |
| PRT72 | 12.5 |
| PRT73 | 25 |
| PRT74 | 50 |
| PRT75 | 50 |
| PRT76 | 25 |
| PRT77 | 25 |
| PRT78 | 50 |
| PRT79 | 50 |
| PRT80 | 12.5 |
| PRT81 | 12.5 |
| PRT82 | 25 |
| PRT83 | 12.5 |
| PRT84 | 12.5 |
| PRT85 | 12.5 |
| PRT86 | 50 |
| PRT87 | 12.5 |
| PRT88 | 25 |
| PRT89 | 25 |
| PRT90 | 50 |
| PRT91 | 12.5 |
| PRT92 | 50 |
| PRT93 | 50 |
| PRT94 | 12.5 |
| PRT95 | 25 |
| PRT96 | 12.5 |
| PRT97 | 25 |
| PRT98 | 12.5 |
| PRT99 | 12.5 |
| PRT100 | 12.5 |
| PRT101 | 25 |
| PRT102 | 12.5 |
| PRT103 | 50 |
| PRT104 | 12.5 |
| PRT105 | 12.5 |
| PRT106 | 12.5 |
| PRT107 | 12.5 |
| PRT108 | 50 |
| PRT109 | 12.5 |
| PRT110 | 25 |
| PRT111 | 12.5 |
| PRT112 | 50 |
| PRT113 | 12.5 |
| PRT114 | 12.5 |
| PRT115 | 12.5 |
| PRT116 | 25 |
| PRT117 | 12.5 |
| PRT118 | 12.5 |
| PRT119 | 12.5 |
| PRT120 | 12.5 |
| PRT121 | 25 |
| PRT122 | 12.5 |
| PRT123 | 25 |
| PRT124 | 12.5 |
| PRT125 | 100 |
| PRT126 | 12.5 |
| PRT127 | 12.5 |
| PRT128 | 12.5 |
| PRT129 | 50 |
| PRT130 | 12.5 |
| PRT131 | 50 |
| PRT132 | 25 |
| PRT133 | 50 |
| PRT134 | 12.5 |
| PRT135 | 25 |
| PRT136 | 12.5 |
| PRT137 | 25 |
| PRT138 | 12.5 |
| PRT139 | 12.5 |
| PRT140 | 12.5 |
| PRT141 | 12.5 |
| PRT142 | 12.5 |
| PRT143 | 12.5 |
| PRT144 | 25 |
| PRT145 | 12.5 |
| PRT146 | 12.5 |
| PRT147 | 12.5 |
| PRT148 | 25 |
| PRT149 | 12.5 |
| PRT150 | 25 |
| PRT151 | 12.5 |
| PRT152 | 12.5 |
| PRT153 | 12.5 |
| PRT154 | 12.5 |
| PRT155 | 12.5 |
| PRT156 | 25 |
| PRT157 | 12.5 |
| PRT158 | 12.5 |
| PRT159 | 25 |
| PRT160 | 12.5 |
| PRT161 | 12.5 |
| PRT162 | 12.5 |
| PRT163 | 12.5 |
| PRT164 | 25 |
| PRT165 | 12.5 |
| PRT166 | 12.5 |
| PRT167 | 12.5 |
| PRT168 | 25 |
| PRT169 | 50 |
| PRT170 | 50 |

TABLE 2-continued

MIC (µg/mL) of the human-originated EGF domain proteins against *E. coli* DH5α

| Protein | MIC |
|---|---|
| PRT171 | 25 |
| PRT172 | 12.5 |
| PRT173 | 12.5 |
| PRT174 | 50 |
| PRT175 | 12.5 |
| PRT176 | 25 |
| PRT177 | 50 |
| PRT178 | 25 |
| PRT179 | 50 |
| PRT180 | 12.5 |
| PRT181 | 25 |
| PRT182 | 12.5 |
| PRT183 | 12.5 |
| PRT184 | 25 |
| PRT185 | 50 |
| PRT186 | 12.5 |
| PRT187 | 25 |
| PRT188 | 12.5 |
| PRT189 | 25 |
| PRT190 | 12.5 |
| PRT191 | 12.5 |
| PRT192 | 25 |
| PRT193 | 50 |
| PRT194 | 12.5 |
| PRT195 | 25 |
| PRT196 | 50 |
| PRT197 | 50 |
| PRT198 | 12.5 |
| PRT199 | 25 |
| PRT200 | 12.5 |
| PRT201 | 50 |
| PRT202 | 25 |
| PRT203 | 12.5 |
| PRT204 | 25 |
| PRT205 | 12.5 |
| PRT206 | 25 |
| PRT207 | 12.5 |
| PRT208 | 25 |
| PRT209 | 12.5 |
| PRT210 | 50 |
| PRT211 | 25 |
| PRT212 | 12.5 |
| PRT213 | 12.5 |
| PRT214 | 12.5 |
| PRT215 | 25 |
| PRT216 | 12.5 |
| PRT217 | 12.5 |
| PRT218 | 100 |
| PRT219 | 12.5 |
| PRT220 | 25 |
| PRT221 | 12.5 |
| PRT222 | 50 |
| PRT223 | 12.5 |
| PRT224 | 25 |
| PRT225 | 12.5 |
| PRT226 | 50 |
| PRT227 | 12.5 |
| PRT228 | 25 |
| PRT229 | 50 |
| PRT230 | 25 |
| PRT231 | 12.5 |
| PRT232 | 25 |
| PRT233 | 12.5 |
| PRT234 | 25 |
| PRT235 | 12.5 |
| PRT236 | 12.5 |
| PRT237 | 25 |
| PRT238 | 25 |
| PRT239 | 25 |
| PRT240 | 25 |
| PRT241 | 12.5 |
| PRT242 | 12.5 |
| PRT243 | 12.5 |
| PRT244 | 50 |
| PRT245 | 12.5 |
| PRT246 | 12.5 |
| PRT247 | 12.5 |
| PRT248 | 12.5 |
| PRT249 | 25 |
| PRT250 | 12.5 |
| PRT251 | 25 |
| PRT252 | 25 |
| PRT253 | 12.5 |
| PRT254 | 25 |
| PRT255 | 12.5 |
| PRT256 | 25 |
| PRT257 | 12.5 |
| PRT258 | 50 |
| PRT259 | 12.5 |
| PRT260 | 12.5 |
| PRT261 | 12.5 |
| PRT262 | 12.5 |
| PRT263 | 25 |
| PRT264 | 12.5 |
| PRT265 | 25 |
| PRT266 | 12.5 |
| PRT267 | 50 |
| PRT268 | 12.5 |
| PRT269 | 12.5 |
| PRT270 | 12.5 |
| PRT271 | 12.5 |
| PRT272 | 25 |
| PRT273 | 12.5 |
| PRT274 | 12.5 |
| PRT275 | 50 |
| PRT276 | 100 |
| PRT277 | 12.5 |
| PRT278 | 50 |
| PRT279 | 12.5 |
| PRT280 | 12.5 |
| PRT281 | 50 |
| PRT282 | 12.5 |
| PRT283 | 12.5 |
| PRT284 | 50 |
| PRT285 | 50 |
| PRT286 | 12.5 |
| PRT287 | 12.5 |
| PRT288 | 12.5 |
| PRT289 | 50 |
| PRT290 | 50 |
| PRT291 | 12.5 |
| PRT292 | 50 |
| PRT293 | 12.5 |
| PRT294 | 12.5 |
| PRT295 | 12.5 |
| PRT296 | 50 |
| PRT297 | 25 |
| PRT298 | 25 |
| PRT299 | 25 |
| PRT300 | 12.5 |
| PRT301 | 50 |
| PRT302 | 12.5 |
| PRT303 | 50 |
| PRT304 | 12.5 |
| PRT305 | 12.5 |
| PRT306 | 50 |
| PRT307 | 25 |
| PRT308 | 12.5 |
| PRT309 | 25 |
| PRT310 | 50 |
| PRT311 | 12.5 |
| PRT312 | 50 |
| PRT313 | 25 |
| PRT314 | 12.5 |
| PRT315 | 12.5 |
| PRT316 | 50 |
| PRT317 | 12.5 |
| PRT318 | 12.5 |
| PRT319 | 25 |
| PRT320 | 50 |

TABLE 2-continued

MIC (µg/mL) of the human-originated EGF domain proteins against *E. coli* DH5α

| Protein | MIC |
|---|---|
| PRT321 | 50 |
| PRT322 | 25 |
| PRT323 | 25 |
| PRT324 | 25 |
| PRT325 | 12.5 |
| PRT326 | 50 |
| PRT327 | 50 |
| PRT328 | 12.5 |
| PRT329 | 25 |
| PRT330 | 12.5 |
| PRT331 | 50 |
| PRT332 | 25 |
| PRT333 | 12.5 |
| PRT334 | 50 |
| PRT335 | 12.5 |
| PRT336 | 50 |
| PRT337 | 50 |
| PRT338 | 50 |
| PRT339 | 50 |
| PRT340 | 25 |
| PRT341 | 50 |
| PRT342 | 50 |
| PRT343 | 25 |
| PRT344 | 50 |
| PRT345 | 12.5 |
| PRT346 | 50 |
| PRT347 | 12.5 |
| PRT348 | 25 |
| PRT349 | 12.5 |
| PRT350 | 25 |
| PRT351 | 12.5 |
| PRT352 | 25 |
| PRT353 | 12.5 |
| PRT354 | 50 |
| PRT355 | 25 |
| PRT356 | 25 |
| PRT357 | 50 |
| PRT358 | 5 |
| PRT359 | 12.5 |
| PRT360 | 50 |
| PRT361 | 25 |
| PRT362 | 25 |
| PRT363 | 25 |
| PRT364 | 12.5 |
| PRT365 | 12.5 |
| PRT366 | 12.5 |
| PRT367 | 25 |
| PRT368 | 12.5 |
| PRT369 | 50 |
| PRT370 | 50 |
| PRT371 | 50 |
| PRT372 | 12.5 |
| PRT373 | 50 |
| PRT374 | 25 |
| PRT375 | 12.5 |
| PRT376 | 50 |
| PRT377 | 12.5 |
| PRT378 | 50 |
| PRT379 | 12.5 |
| PRT380 | 50 |
| PRT381 | 12.5 |
| PRT382 | 50 |
| PRT383 | 25 |
| PRT384 | 50 |
| PRT385 | 25 |
| PRT386 | 25 |
| PRT387 | 12.5 |
| PRT388 | 12.5 |
| PRT389 | 12.5 |
| PRT390 | 12.5 |
| PRT391 | 50 |
| PRT392 | 12.5 |
| PRT393 | 50 |
| PRT394 | 12.5 |
| PRT395 | 25 |
| PRT396 | 50 |
| PRT397 | 12.5 |
| PRT398 | 50 |
| PRT399 | 12.5 |
| PRT400 | 50 |
| PRT401 | 50 |
| PRT402 | 12.5 |
| PRT403 | 12.5 |
| PRT404 | 25 |
| PRT405 | 12.5 |
| PRT406 | 50 |
| PRT407 | 25 |
| PRT408 | 12.5 |
| PRT409 | 50 |
| PRT410 | 12.5 |
| PRT411 | 25 |
| PRT412 | 12.5 |
| PRT413 | 12.5 |
| PRT414 | 12.5 |
| PRT415 | 25 |
| PRT416 | 50 |
| PRT417 | 25 |
| PRT418 | 12.5 |
| PRT419 | 25 |
| PRT420 | 50 |
| PRT421 | 12.5 |
| PRT422 | 12.5 |
| PRT423 | 12.5 |
| PRT424 | 25 |
| PRT425 | 12.5 |
| PRT426 | 12.5 |
| PRT427 | 25 |
| PRT428 | 50 |
| PRT429 | 12.5 |
| PRT430 | 12.5 |
| PRT431 | 50 |
| PRT432 | 25 |
| PRT433 | 12.5 |
| PRT434 | 12.5 |
| PRT435 | 12.5 |
| PRT436 | 12.5 |
| PRT437 | 50 |
| PRT438 | 25 |
| PRT439 | 25 |
| PRT440 | 50 |
| PRT441 | 12.5 |
| PRT442 | 12.5 |
| PRT443 | 12.5 |
| PRT444 | 25 |
| PRT445 | 50 |
| PRT446 | 12.5 |
| PRT447 | 50 |
| PRT448 | 12.5 |
| PRT449 | 50 |
| PRT450 | 12.5 |
| PRT451 | 25 |
| PRT452 | 12.5 |
| PRT453 | 25 |
| PRT454 | 50 |
| PRT455 | 50 |
| PRT456 | 25 |
| PRT457 | 50 |
| PRT458 | 50 |
| PRT459 | 25 |
| PRT460 | 50 |
| PRT461 | 50 |
| PRT462 | 12.5 |
| PRT463 | 50 |
| PRT464 | 12.5 |
| PRT465 | 50 |
| PRT466 | 12.5 |
| PRT467 | 12.5 |
| PRT468 | 25 |
| PRT469 | 12.5 |
| PRT470 | 50 |

TABLE 2-continued

MIC (μg/mL) of the human-originated EGF domain proteins against *E. coli* DH5α

| Protein | MIC |
|---|---|
| PRT471 | 100 |
| PRT472 | 25 |
| PRT473 | 50 |
| PRT474 | 12.5 |
| PRT475 | 50 |
| PRT476 | 12.5 |
| PRT477 | 12.5 |
| PRT478 | 50 |
| PRT479 | 25 |
| PRT480 | 12.5 |
| PRT481 | 25 |
| PRT482 | 50 |
| PRT483 | 12.5 |
| PRT484 | 25 |
| PRT485 | 50 |
| PRT486 | 12.5 |
| PRT487 | 12.5 |
| PRT488 | 50 |
| PRT489 | 12.5 |
| PRT490 | 25 |
| PRT491 | 12.5 |
| PRT492 | 25 |
| PRT493 | 12.5 |
| PRT494 | 50 |
| PRT495 | 25 |
| PRT496 | 12.5 |
| PRT497 | 12.5 |
| PRT498 | 12.5 |
| PRT499 | 12.5 |
| PRT500 | 25 |
| PRT501 | 12.5 |
| PRT502 | 25 |
| PRT503 | 12.5 |
| PRT504 | 12.5 |
| PRT505 | 50 |
| PRT506 | 25 |
| PRT507 | 12.5 |
| PRT508 | 12.5 |
| PRT509 | 12.5 |
| PRT510 | 50 |
| PRT511 | 50 |
| PRT512 | 50 |
| PRT513 | 50 |
| PRT514 | 50 |
| PRT515 | 25 |
| PRT516 | 12.5 |
| PRT517 | 25 |
| PRT518 | 50 |
| PRT519 | 25 |
| PRT520 | 25 |
| PRT521 | 50 |
| PRT522 | 25 |
| PRT523 | 12.5 |
| PRT524 | 12.5 |
| PRT525 | 25 |
| PRT526 | 50 |
| PRT527 | 50 |
| PRT528 | 12.5 |
| PRT529 | 25 |
| PRT530 | 50 |
| PRT531 | 50 |
| PRT532 | 12.5 |
| PRT533 | 50 |
| PRT534 | 50 |
| PRT535 | 12.5 |
| PRT536 | 12.5 |
| PRT537 | 50 |
| PRT538 | 25 |
| PRT539 | 12.5 |
| PRT540 | 12.5 |
| PRT541 | 12.5 |
| PRT542 | 25 |
| PRT543 | 12.5 |
| PRT544 | 12.5 |
| PRT545 | 12.5 |
| PRT546 | 12.5 |
| PRT547 | 25 |
| PRT548 | 12.5 |
| PRT549 | 12.5 |
| PRT550 | 25 |
| PRT551 | 12.5 |
| PRT552 | 25 |
| PRT553 | 25 |
| PRT554 | 12.5 |
| PRT555 | 50 |
| PRT556 | 25 |
| PRT557 | 12.5 |
| PRT558 | 12.5 |
| PRT559 | 25 |
| PRT560 | 12.5 |
| PRT561 | 50 |
| PRT562 | 50 |
| PRT563 | 25 |
| PRT564 | 50 |
| PRT565 | 50 |
| PRT566 | 50 |
| PRT567 | 50 |
| PRT568 | 12.5 |
| PRT569 | 25 |
| PRT570 | 25 |
| PRT571 | 12.5 |
| PRT572 | 12.5 |
| PRT573 | 25 |
| PRT574 | 50 |
| PRT575 | 50 |
| PRT576 | 12.5 |
| PRT577 | 12.5 |
| PRT578 | 12.5 |
| PRT579 | 12.5 |
| PRT580 | 12.5 |
| PRT581 | 50 |
| PRT582 | 12.5 |
| PRT583 | 25 |
| PRT584 | 50 |
| PRT585 | 50 |
| PRT586 | 12.5 |
| PRT587 | 25 |
| PRT588 | 12.5 |
| PRT589 | 12.5 |
| PRT590 | 50 |
| PRT591 | 25 |
| PRT592 | 50 |
| PRT593 | 25 |
| PRT594 | 12.5 |
| PRT595 | 12.5 |
| PRT596 | 12.5 |
| PRT597 | 25 |
| PRT598 | 25 |
| PRT599 | 12.5 |
| PRT600 | 25 |
| PRT601 | 50 |
| PRT602 | 50 |
| PRT603 | 25 |
| PRT604 | 50 |
| PRT605 | 12.5 |
| PRT606 | 25 |
| PRT607 | 50 |
| PRT608 | 12.5 |
| PRT609 | 50 |
| PRT610 | 50 |
| PRT611 | 12.5 |
| PRT612 | 25 |
| PRT613 | 50 |
| PRT614 | 50 |
| PRT615 | 12.5 |
| PRT616 | 25 |
| PRT617 | 25 |
| PRT618 | 50 |
| PRT619 | 12.5 |
| PRT620 | 25 |

TABLE 2-continued

MIC (µg/mL) of the human-originated EGF domain proteins against *E. coli* DH5α

| Protein | MIC |
|---|---|
| PRT621 | 50 |
| PRT622 | 25 |
| PRT623 | 12.5 |
| PRT624 | 25 |
| PRT625 | 12.5 |
| PRT626 | 25 |
| PRT627 | 12.5 |
| PRT628 | 12.5 |
| PRT629 | 12.5 |
| PRT630 | 50 |
| PRT631 | 25 |
| PRT632 | 12.5 |
| PRT633 | 12.5 |
| PRT634 | 12.5 |
| PRT635 | 12.5 |
| PRT636 | 12.5 |
| PRT637 | 25 |
| PRT638 | 25 |
| PRT639 | 12.5 |
| PRT640 | 12.5 |
| PRT641 | 50 |
| PRT642 | 12.5 |
| PRT643 | 12.5 |
| PRT644 | 25 |
| PRT645 | 50 |
| PRT646 | 12.5 |
| PRT647 | 25 |
| PRT648 | 12.5 |
| PRT649 | 50 |
| PRT650 | 12.5 |
| PRT651 | 12.5 |
| PRT652 | 12.5 |
| PRT653 | 25 |
| PRT654 | 12.5 |
| PRT655 | 25 |
| PRT656 | 50 |
| PRT657 | 12.5 |
| PRT658 | 12.5 |
| PRT659 | 25 |
| PRT660 | 12.5 |
| PRT661 | 50 |
| PRT662 | 25 |
| PRT663 | 100 |
| PRT664 | 25 |
| PRT665 | 25 |
| PRT666 | 12.5 |
| PRT667 | 50 |
| PRT668 | 12.5 |
| PRT669 | 25 |
| PRT670 | 25 |
| PRT671 | 50 |
| PRT672 | 12.5 |
| PRT673 | 50 |
| PRT674 | 12.5 |
| PRT675 | 12.5 |
| PRT676 | 25 |
| PRT677 | 50 |
| PRT678 | 25 |
| PRT679 | 12.5 |
| PRT680 | 12.5 |
| PRT681 | 12.5 |
| PRT682 | 25 |
| PRT683 | 12.5 |
| PRT684 | 12.5 |
| PRT685 | 50 |
| PRT686 | 50 |
| PRT687 | 50 |
| PRT688 | 25 |
| PRT689 | 100 |
| PRT690 | 25 |
| PRT691 | 25 |
| PRT692 | 50 |
| PRT693 | 25 |
| PRT694 | 50 |
| PRT695 | 25 |
| PRT696 | 50 |
| PRT697 | 25 |
| PRT698 | 50 |
| PRT699 | 50 |
| PRT700 | 25 |
| PRT701 | 50 |
| PRT702 | 25 |
| PRT703 | 25 |
| PRT704 | 50 |
| PRT705 | 25 |
| PRT706 | 25 |
| PRT707 | 50 |
| PRT708 | 50 |
| PRT709 | 50 |
| PRT710 | 25 |
| PRT711 | 25 |
| PRT712 | 25 |
| PRT713 | 50 |
| PRT714 | 12.5 |
| PRT715 | 50 |
| PRT716 | 25 |
| PRT717 | 50 |
| PRT718 | 12.5 |
| PRT719 | 50 |
| PRT720 | 50 |
| PRT721 | 25 |
| PRT722 | 12.5 |
| PRT723 | 25 |
| PRT724 | 12.5 |
| PRT725 | 25 |
| PRT726 | 12.5 |
| PRT727 | 12.5 |
| PRT728 | 25 |
| PRT729 | 12.5 |
| PRT730 | 25 |
| PRT731 | 50 |
| PRT732 | 12.5 |
| PRT733 | 50 |
| PRT734 | 50 |
| PRT735 | 12.5 |
| PRT736 | 12.5 |
| PRT737 | 12.5 |
| PRT738 | 50 |
| PRT739 | 12.5 |
| PRT740 | 12.5 |
| PRT741 | 12.5 |
| PRT742 | 50 |
| PRT743 | 12.5 |
| PRT744 | 12.5 |
| PRT745 | 50 |
| PRT746 | 12.5 |
| PRT747 | 50 |
| PRT748 | 50 |
| PRT749 | 50 |
| PRT750 | 25 |
| PRT751 | 12.5 |
| PRT752 | 50 |
| PRT753 | 25 |
| PRT754 | 25 |
| PRT755 | 12.5 |
| PRT756 | 12.5 |
| PRT757 | 50 |
| PRT758 | 12.5 |
| PRT759 | 25 |
| PRT760 | 50 |
| PRT761 | 50 |
| PRT762 | 50 |
| PRT763 | 25 |
| PRT764 | 12.5 |
| PRT765 | 12.5 |
| PRT766 | 25 |
| PRT767 | 25 |
| PRT768 | 12.5 |
| PRT769 | 12.5 |
| PRT770 | 50 |

TABLE 2-continued

MIC (μg/mL) of the human-originated EGF domain proteins against *E. coli* DH5α

| Protein | MIC |
|---|---|
| PRT771 | 25 |
| PRT772 | 12.5 |
| PRT773 | 50 |
| PRT774 | 50 |
| PRT775 | 12.5 |
| PRT776 | 12.5 |
| PRT777 | 50 |
| PRT778 | 50 |
| PRT779 | 12.5 |
| PRT780 | 12.5 |
| PRT781 | 25 |
| PRT782 | 50 |
| PRT783 | 25 |
| PRT784 | 50 |
| PRT785 | 25 |
| PRT786 | 50 |
| PRT787 | 12.5 |
| PRT788 | 50 |
| PRT789 | 25 |
| PRT790 | 25 |
| PRT791 | 50 |
| PRT792 | 12.5 |
| PRT793 | 25 |
| PRT794 | 50 |
| PRT795 | 50 |
| PRT796 | 25 |
| PRT797 | 50 |
| PRT798 | 12.5 |
| PRT799 | 25 |
| PRT800 | 25 |
| PRT801 | 25 |
| PRT802 | 12.5 |
| PRT803 | 50 |
| PRT804 | 12.5 |
| PRT805 | 12.5 |
| PRT806 | 12.5 |
| PRT807 | 25 |
| PRT808 | 25 |
| PRT809 | 25 |
| PRT810 | 25 |
| PRT811 | 12.5 |
| PRT812 | 12.5 |
| PRT813 | 50 |
| PRT814 | 25 |
| PRT815 | 25 |
| PRT816 | 25 |
| PRT817 | 50 |
| PRT818 | 25 |
| PRT819 | 12.5 |
| PRT820 | 12.5 |
| PRT821 | 12.5 |
| PRT822 | 12.5 |
| PRT823 | 25 |
| PRT824 | 12.5 |
| PRT825 | 25 |
| PRT826 | 12.5 |
| PRT827 | 12.5 |
| PRT828 | 12.5 |
| PRT829 | 50 |
| PRT830 | 12.5 |
| PRT831 | 25 |
| PRT832 | 50 |
| PRT833 | 12.5 |
| PRT834 | 50 |
| PRT835 | 25 |
| PRT836 | 50 |
| PRT837 | 25 |
| PRT838 | 50 |
| PRT839 | 12.5 |
| PRT840 | 25 |
| PRT841 | 12.5 |
| PRT842 | 12.5 |
| PRT843 | 25 |
| PRT844 | 12.5 |
| PRT845 | 25 |
| PRT846 | 25 |
| PRT847 | 12.5 |
| PRT848 | 25 |
| PRT849 | 12.5 |
| PRT850 | 50 |
| PRT851 | 25 |
| PRT852 | 12.5 |
| PRT853 | 25 |
| PRT854 | 12.5 |
| PRT855 | 50 |
| PRT856 | 25 |
| PRT857 | 25 |
| PRT858 | 12.5 |
| PRT859 | 50 |
| PRT860 | 25 |
| PRT861 | 12.5 |
| PRT862 | 12.5 |
| PRT863 | 50 |
| PRT864 | 12.5 |
| PRT865 | 25 |
| PRT866 | 25 |
| PRT867 | 50 |
| PRT868 | 12.5 |
| PRT869 | 12.5 |
| PRT870 | 12.5 |
| PRT871 | 12.5 |
| PRT872 | 25 |
| PRT873 | 12.5 |
| PRT874 | 12.5 |
| PRT875 | 25 |
| PRT876 | 12.5 |
| PRT877 | 25 |
| PRT878 | 50 |
| PRT879 | 25 |
| PRT880 | 25 |
| PRT881 | 12.5 |
| PRT882 | 25 |
| PRT883 | 12.5 |
| PRT884 | 12.5 |
| PRT885 | 25 |
| PRT886 | 25 |
| PRT887 | 12.5 |
| PRT888 | 12.5 |
| PRT889 | 25 |
| PRT890 | 50 |
| PRT891 | 12.5 |
| PRT892 | 25 |
| PRT893 | 12.5 |
| PRT894 | 12.5 |
| PRT895 | 50 |
| PRT896 | 25 |
| PRT897 | 50 |
| PRT898 | 25 |
| PRT899 | 12.5 |
| PRT900 | 12.5 |
| PRT901 | 25 |
| PRT902 | 50 |
| PRT903 | 12.5 |
| PRT904 | 50 |
| PRT905 | 25 |
| PRT906 | 50 |
| PRT907 | 25 |
| PRT908 | 50 |
| PRT909 | 50 |
| PRT910 | 50 |
| PRT911 | 12.5 |
| PRT912 | 25 |
| PRT913 | 12.5 |
| PRT914 | 12.5 |
| PRT915 | 25 |
| PRT916 | 25 |
| PRT917 | 25 |
| PRT918 | 12.5 |
| PRT919 | 50 |
| PRT920 | 12.5 |

TABLE 2-continued

MIC (µg/mL) of the human-originated EGF domain proteins against *E. coli* DH5α

| Protein | MIC |
|---|---|
| PRT921 | 12.5 |
| PRT922 | 12.5 |
| PRT923 | 25 |
| PRT924 | 12.5 |
| PRT925 | 12.5 |
| PRT926 | 25 |
| PRT927 | 25 |
| PRT928 | 25 |
| PRT929 | 100 |
| PRT930 | 50 |
| PRT931 | 12.5 |
| PRT932 | 25 |
| PRT933 | 12.5 |
| PRT934 | 12.5 |
| PRT935 | 12.5 |
| PRT936 | 25 |
| PRT937 | 25 |
| PRT938 | 12.5 |
| PRT939 | 50 |
| PRT940 | 12.5 |
| PRT941 | 25 |
| PRT942 | 25 |
| PRT943 | 12.5 |
| PRT944 | 12.5 |
| PRT945 | 25 |
| PRT946 | 50 |
| PRT947 | 12.5 |
| PRT948 | 50 |
| PRT949 | 12.5 |
| PRT950 | 50 |
| PRT951 | 25 |
| PRT952 | 50 |
| PRT953 | 12.5 |
| PRT954 | 50 |
| PRT955 | 50 |
| PRT956 | 12.5 |
| PRT957 | 12.5 |
| PRT958 | 50 |
| PRT959 | 25 |
| PRT960 | 12.5 |
| PRT961 | 12.5 |
| PRT962 | 25 |
| PRT963 | 25 |
| PRT964 | 12.5 |
| PRT965 | 12.5 |
| PRT966 | 50 |
| PRT967 | 50 |
| PRT968 | 25 |
| PRT969 | 50 |
| PRT970 | 50 |
| PRT971 | 50 |
| PRT972 | 50 |
| PRT973 | 12.5 |
| PRT974 | 25 |
| PRT975 | 25 |
| PRT976 | 50 |
| PRT977 | 12.5 |
| PRT978 | 12.5 |
| PRT979 | 50 |
| PRT980 | 12.5 |
| PRT981 | 25 |
| PRT982 | 50 |
| PRT983 | 25 |
| PRT984 | 50 |
| PRT985 | 50 |
| PRT986 | 12.5 |
| PRT987 | 25 |
| PRT988 | 12.5 |
| PRT989 | 50 |
| PRT990 | 12.5 |
| PRT991 | 50 |
| PRT992 | 12.5 |
| PRT993 | 12.5 |
| PRT994 | 50 |
| PRT995 | 12.5 |
| PRT996 | 25 |
| PRT997 | 12.5 |
| PRT998 | 12.5 |
| PRT999 | 12.5 |
| PRT1000 | 50 |
| PRT1001 | 12.5 |
| PRT1002 | 25 |
| PRT1003 | 50 |
| PRT1004 | 50 |
| PRT1005 | 50 |
| PRT1006 | 12.5 |
| PRT1007 | 25 |
| PRT1008 | 50 |
| PRT1009 | 25 |
| PRT1010 | 50 |
| PRT1011 | 12.5 |
| PRT1012 | 12.5 |
| PRT1013 | 12.5 |
| PRT1014 | 12.5 |
| PRT1015 | 12.5 |
| PRT1016 | 12.5 |
| PRT1017 | 50 |
| PRT1018 | 25 |
| PRT1019 | 12.5 |
| PRT1020 | 12.5 |
| PRT1021 | 25 |
| PRT1022 | 12.5 |
| PRT1023 | 25 |
| PRT1024 | 50 |
| PRT1025 | 50 |
| PRT1026 | 12.5 |
| PRT1027 | 12.5 |
| PRT1028 | 12.5 |
| PRT1029 | 12.5 |
| PRT1030 | 25 |
| PRT1031 | 12.5 |
| PRT1032 | 50 |
| PRT1033 | 50 |
| PRT1034 | 25 |
| PRT1035 | 12.5 |
| PRT1036 | 25 |
| PRT1037 | 12.5 |
| PRT1038 | 50 |
| PRT1039 | 50 |
| PRT1040 | 12.5 |
| PRT1041 | 12.5 |
| PRT1042 | 25 |
| PRT1043 | 50 |
| PRT1044 | 100 |
| PRT1045 | 25 |
| PRT1046 | 50 |
| PRT1047 | 50 |
| PRT1048 | 12.5 |
| PRT1049 | 12.5 |
| PRT1050 | 25 |
| PRT1051 | 50 |
| PRT1052 | 12.5 |
| PRT1053 | 12.5 |
| PRT1054 | 25 |
| PRT1055 | 12.5 |
| PRT1056 | 50 |
| PRT1057 | 25 |
| PRT1058 | 12.5 |
| PRT1059 | 50 |
| PRT1060 | 12.5 |
| PRT1061 | 12.5 |
| PRT1062 | 25 |
| PRT1063 | 12.5 |
| PRT1064 | 25 |
| PRT1065 | 50 |
| PRT1066 | 12.5 |
| PRT1067 | 25 |
| PRT1068 | 12.5 |
| PRT1069 | 12.5 |
| PRT1070 | 25 |

TABLE 2-continued

MIC (µg/mL) of the human-originated EGF domain proteins against *E. coli* DH5α

| Protein | MIC |
|---|---|
| PRT1071 | 50 |
| PRT1072 | 50 |
| PRT1073 | 25 |
| PRT1074 | 50 |
| PRT1075 | 25 |
| PRT1076 | 12.5 |
| PRT1077 | 12.5 |
| PRT1078 | 25 |
| PRT1079 | 50 |
| PRT1080 | 50 |
| PRT1081 | 25 |
| PRT1082 | 50 |
| PRT1083 | 50 |
| PRT1084 | 50 |
| PRT1085 | 25 |
| PRT1086 | 12.5 |
| PRT1087 | 50 |
| PRT1088 | 25 |
| PRT1089 | 50 |
| PRT1090 | 25 |
| PRT1091 | 12.5 |
| PRT1092 | 25 |
| PRT1093 | 12.5 |
| PRT1094 | 25 |
| PRT1095 | 50 |
| PRT1096 | 12.5 |
| PRT1097 | 25 |
| PRT1098 | 12.5 |
| PRT1099 | 12.5 |
| PRT1100 | 12.5 |
| PRT1101 | 25 |
| PRT1102 | 12.5 |
| PRT1103 | 12.5 |
| PRT1104 | 50 |
| PRT1105 | 12.5 |
| PRT1106 | 25 |
| PRT1107 | 12.5 |
| PRT1108 | 50 |
| PRT1109 | 12.5 |
| PRT1110 | 25 |
| PRT1111 | 12.5 |
| PRT1112 | 50 |
| PRT1113 | 12.5 |
| PRT1114 | 25 |
| PRT1115 | 50 |
| PRT1116 | 25 |
| PRT1117 | 50 |
| PRT1118 | 25 |
| PRT1119 | 100 |
| PRT1120 | 25 |
| PRT1121 | 12.5 |
| PRT1122 | 50 |
| PRT1123 | 25 |
| PRT1124 | 25 |
| PRT1125 | 25 |
| PRT1126 | 25 |
| PRT1127 | 12.5 |
| PRT1128 | 12.5 |
| PRT1129 | 50 |
| PRT1130 | 12.5 |
| PRT1131 | 50 |
| PRT1132 | 50 |
| PRT1133 | 12.5 |
| PRT1134 | 12.5 |
| PRT1135 | 25 |
| PRT1136 | 50 |
| PRT1137 | 25 |
| PRT1138 | 25 |
| PRT1139 | 12.5 |
| PRT1140 | 25 |
| PRT1141 | 50 |
| PRT1142 | 25 |
| PRT1143 | 12.5 |
| PRT1144 | 50 |
| PRT1145 | 12.5 |
| PRT1146 | 50 |
| PRT1147 | 50 |
| PRT1148 | 12.5 |
| PRT1149 | 25 |
| PRT1150 | 12.5 |
| PRT1151 | 25 |
| PRT1152 | 12.5 |
| PRT1153 | 12.5 |
| PRT1154 | 50 |
| PRT1155 | 25 |
| PRT1156 | 50 |
| PRT1157 | 12.5 |
| PRT1158 | 25 |
| PRT1159 | 12.5 |
| PRT1160 | 12.5 |
| PRT1161 | 25 |
| PRT1162 | 12.5 |
| PRT1163 | 12.5 |
| PRT1164 | 12.5 |
| PRT1165 | 50 |
| PRT1166 | 50 |
| PRT1167 | 50 |
| PRT1168 | 25 |
| PRT1169 | 50 |
| PRT1170 | 25 |
| PRT1171 | 12.5 |
| PRT1172 | 12.5 |
| PRT1173 | 12.5 |
| PRT1174 | 12.5 |
| PRT1175 | 12.5 |
| PRT1176 | 12.5 |
| PRT1177 | 50 |
| PRT1178 | 50 |
| PRT1179 | 12.5 |
| PRT1180 | 50 |
| PRT1181 | 12.5 |
| PRT1182 | 12.5 |
| PRT1183 | 25 |
| PRT1184 | 50 |
| PRT1185 | 50 |
| PRT1186 | 50 |
| PRT1187 | 50 |
| PRT1188 | 25 |
| PRT1189 | 50 |
| PRT1190 | 50 |
| PRT1191 | 12.5 |
| PRT1192 | 25 |
| PRT1193 | 12.5 |
| PRT1194 | 50 |
| PRT1195 | 25 |
| PRT1196 | 12.5 |
| PRT1197 | 25 |
| PRT1198 | 25 |
| PRT1199 | 50 |
| PRT1200 | 12.5 |
| PRT1201 | 12.5 |
| PRT1202 | 50 |
| PRT1203 | 25 |
| PRT1204 | 100 |
| PRT1205 | 25 |
| PRT1206 | 50 |
| PRT1207 | 12.5 |
| PRT1208 | 12.5 |
| PRT1209 | 50 |
| PRT1210 | 25 |
| PRT1211 | 50 |
| PRT1212 | 50 |
| PRT1213 | 25 |
| PRT1214 | 25 |
| PRT1215 | 25 |
| PRT1216 | 50 |
| PRT1217 | 50 |
| PRT1218 | 12.5 |
| PRT1219 | 12.5 |
| PRT1220 | 12.5 |

TABLE 2-continued

MIC (µg/mL) of the human-originated EGF domain proteins against *E. coli* DH5α

| Protein | MIC |
|---|---|
| PRT1221 | 25 |
| PRT1222 | 12.5 |
| PRT1223 | 50 |
| PRT1224 | 25 |
| PRT1225 | 25 |
| PRT1226 | 25 |
| PRT1227 | 50 |
| PRT1228 | 12.5 |
| PRT1229 | 25 |
| PRT1230 | 12.5 |
| PRT1231 | 12.5 |
| PRT1232 | 50 |
| PRT1233 | 25 |
| PRT1234 | 25 |
| PRT1235 | 12.5 |
| PRT1236 | 50 |
| PRT1237 | 12.5 |
| PRT1238 | 25 |
| PRT1239 | 25 |
| PRT1240 | 12.5 |
| PRT1241 | 50 |
| PRT1242 | 25 |
| PRT1243 | 12.5 |
| PRT1244 | 50 |
| PRT1245 | 50 |
| PRT1246 | 50 |
| PRT1247 | 50 |
| PRT1248 | 25 |
| PRT1249 | 12.5 |
| PRT1250 | 12.5 |
| PRT1251 | 100 |
| PRT1252 | 12.5 |
| PRT1253 | 50 |
| PRT1254 | 12.5 |
| PRT1255 | 12.5 |
| PRT1256 | 25 |
| PRT1257 | 12.5 |
| PRT1258 | 12.5 |
| PRT1259 | 25 |
| PRT1260 | 25 |
| PRT1261 | 12.5 |
| PRT1262 | 12.5 |
| PRT1263 | 100 |
| PRT1264 | 12.5 |
| PRT1265 | 25 |
| PRT1266 | 50 |
| PRT1267 | 12.5 |
| PRT1268 | 50 |
| PRT1269 | 12.5 |
| PRT1270 | 50 |
| PRT1271 | 25 |
| PRT1272 | 25 |
| PRT1273 | 12.5 |
| PRT1274 | 12.5 |
| PRT1275 | 12.5 |
| PRT1276 | 50 |
| PRT1277 | 12.5 |
| PRT1278 | 25 |
| PRT1279 | 50 |
| PRT1280 | 25 |
| PRT1281 | 50 |
| PRT1282 | 12.5 |
| PRT1283 | 12.5 |
| PRT1284 | 25 |
| PRT1285 | 12.5 |
| PRT1286 | 12.5 |
| PRT1287 | 50 |
| PRT1288 | 50 |
| PRT1289 | 12.5 |
| PRT1290 | 50 |
| PRT1291 | 50 |
| PRT1292 | 12.5 |
| PRT1293 | 25 |
| PRT1294 | 50 |
| PRT1295 | 12.5 |
| PRT1296 | 50 |
| PRT1297 | 12.5 |
| PRT1298 | 12.5 |
| PRT1299 | 25 |
| PRT1300 | 12.5 |
| PRT1301 | 12.5 |
| PRT1302 | 12.5 |
| PRT1303 | 12.5 |
| PRT1304 | 25 |
| PRT1305 | 12.5 |
| PRT1306 | 25 |
| PRT1307 | 12.5 |
| PRT1308 | 50 |
| PRT1309 | 12.5 |
| PRT1310 | 12.5 |
| PRT1311 | 50 |
| PRT1312 | 50 |
| PRT1313 | 12.5 |
| PRT1314 | 12.5 |
| PRT1315 | 25 |
| PRT1316 | 50 |
| PRT1317 | 50 |
| PRT1318 | 25 |
| PRT1319 | 12.5 |
| PRT1320 | 25 |
| PRT1321 | 50 |
| PRT1322 | 12.5 |
| PRT1323 | 12.5 |
| PRT1324 | 12.5 |
| PRT1325 | 12.5 |
| PRT1326 | 50 |
| PRT1327 | 25 |
| PRT1328 | 12.5 |
| PRT1329 | 12.5 |
| PRT1330 | 12.5 |
| PRT1331 | 25 |
| PRT1332 | 50 |
| PRT1333 | 25 |
| PRT1334 | 12.5 |
| PRT1335 | 50 |
| PRT1336 | 12.5 |
| PRT1337 | 12.5 |
| PRT1338 | 50 |
| PRT1339 | 25 |
| PRT1340 | 12.5 |
| PRT1341 | 12.5 |
| PRT1342 | 25 |
| PRT1343 | 12.5 |
| PRT1344 | 12.5 |
| PRT1345 | 12.5 |
| PRT1346 | 12.5 |
| PRT1347 | 25 |
| PRT1348 | 12.5 |
| PRT1349 | 50 |
| PRT1350 | 50 |
| PRT1351 | 25 |
| PRT1352 | 12.5 |
| PRT1353 | 12.5 |
| PRT1354 | 25 |
| PRT1355 | 50 |
| PRT1356 | 12.5 |
| PRT1357 | 50 |
| PRT1358 | 50 |
| PRT1359 | 25 |
| PRT1360 | 12.5 |
| PRT1361 | 25 |
| PRT1362 | 12.5 |
| PRT1363 | 12.5 |
| PRT1364 | 25 |
| PRT1365 | 12.5 |
| PRT1366 | 12.5 |
| PRT1367 | 25 |
| PRT1368 | 12.5 |
| PRT1369 | 12.5 |
| PRT1370 | 25 |

TABLE 2-continued

MIC (µg/mL) of the human-originated EGF domain proteins against *E. coli* DH5α

| Protein | MIC |
|---|---|
| PRT1371 | 50 |
| PRT1372 | 12.5 |
| PRT1373 | 25 |
| PRT1374 | 50 |
| PRT1375 | 12.5 |
| PRT1376 | 50 |
| PRT1377 | 25 |
| PRT1378 | 50 |
| PRT1379 | 50 |
| PRT1380 | 25 |
| PRT1381 | 12.5 |
| PRT1382 | 25 |
| PRT1383 | 12.5 |
| PRT1384 | 25 |
| PRT1385 | 12.5 |
| PRT1386 | 25 |
| PRT1387 | 12.5 |
| PRT1388 | 100 |
| PRT1389 | 25 |
| PRT1390 | 12.5 |
| PRT1391 | 12.5 |
| PRT1392 | 12.5 |
| PRT1393 | 25 |
| PRT1394 | 50 |
| PRT1395 | 12.5 |
| PRT1396 | 12.5 |
| PRT1397 | 50 |
| PRT1398 | 25 |
| PRT1399 | 12.5 |
| PRT1400 | 50 |
| PRT1401 | 12.5 |
| PRT1402 | 25 |
| PRT1403 | 50 |
| PRT1404 | 12.5 |
| PRT1405 | 12.5 |
| PRT1406 | 25 |
| PRT1407 | 50 |
| PRT1408 | 25 |
| PRT1409 | 12.5 |
| PRT1410 | 25 |
| PRT1411 | 12.5 |
| PRT1412 | 25 |
| PRT1413 | 12.5 |
| PRT1414 | 50 |
| PRT1415 | 25 |
| PRT1416 | 25 |
| PRT1417 | 25 |
| PRT1418 | 25 |
| PRT1419 | 12.5 |
| PRT1420 | 12.5 |
| PRT1421 | 12.5 |
| PRT1422 | 12.5 |
| PRT1423 | 50 |
| PRT1424 | 50 |
| PRT1425 | 12.5 |
| PRT1426 | 12.5 |
| PRT1427 | 25 |
| PRT1428 | 12.5 |
| PRT1429 | 25 |
| PRT1430 | 25 |
| PRT1431 | 12.5 |
| PRT1432 | 25 |
| PRT1433 | 12.5 |
| PRT1434 | 25 |
| PRT1435 | 50 |
| PRT1436 | 12.5 |
| PRT1437 | 12.5 |
| PRT1438 | 12.5 |
| PRT1439 | 50 |
| PRT1440 | 12.5 |
| PRT1441 | 25 |
| PRT1442 | 12.5 |
| PRT1443 | 25 |
| PRT1444 | 12.5 |
| PRT1445 | 50 |
| PRT1446 | 12.5 |
| PRT1447 | 100 |
| PRT1448 | 25 |
| PRT1449 | 50 |
| PRT1450 | 12.5 |
| PRT1451 | 25 |
| PRT1452 | 12.5 |
| PRT1453 | 25 |
| PRT1454 | 25 |
| PRT1455 | 25 |
| PRT1456 | 12.5 |
| PRT1457 | 12.5 |
| PRT1458 | 12.5 |
| PRT1459 | 12.5 |
| PRT1460 | 12.5 |
| PRT1461 | 25 |
| PRT1462 | 12.5 |
| PRT1463 | 50 |
| PRT1464 | 12.5 |
| PRT1465 | 12.5 |
| PRT1466 | 50 |
| PRT1467 | 25 |
| PRT1468 | 50 |
| PRT1469 | 25 |
| PRT1470 | 50 |
| PRT1471 | 12.5 |
| PRT1472 | 50 |
| PRT1473 | 12.5 |
| PRT1474 | 50 |
| PRT1475 | 25 |
| PRT1476 | 12.5 |
| PRT1477 | 50 |
| PRT1478 | 50 |
| PRT1479 | 50 |
| PRT1480 | 50 |
| PRT1481 | 12.5 |
| PRT1482 | 12.5 |
| PRT1483 | 12.5 |
| PRT1484 | 50 |
| PRT1485 | 12.5 |
| PRT1486 | 12.5 |
| PRT1487 | 25 |
| PRT1488 | 25 |
| PRT1489 | 25 |
| PRT1490 | 12.5 |
| PRT1491 | 25 |
| PRT1492 | 25 |
| PRT1493 | 100 |
| PRT1494 | 25 |
| PRT1495 | 25 |
| PRT1496 | 50 |
| PRT1497 | 50 |
| PRT1498 | 50 |

It can be known from the above table that: all of the human-originated EGF domain proteins (PRT1 to PRT1498 in Table 1) have an inhibitory effect on *E. coli* DH5α.

Example 16: Effect of the Human-Originated EGF Domain Proteins (PRT1 to PRT1498 in Table 1) Such as the Recombination Protein hF VII-EGF1, Etc on the Growth of Various Gram-Negative Bacteria 1. Gram-negative bacteria, such as *E. coli* BL21, *Pseudomonas aeruginosa*, *Klebsiella pneumonia*, *Enterobacter cloacae*, *Aeromonas hydrophila*, *Citrobacter diversus*, *Moraxella catarrhalis*, *Proteus mirabilis*, *Proteus vulgaris*, *Serratia marcescens*, etc were streaked on solid LB medium and cultured respectively. Then, typical clones were picked, inoculated into common liquid LB medium respectively, and cultured at 37° C. with shaking at 185 rpm until the McFarland specific turbidity was 0.5. The bacterial culture of each of Gram-negative bacteria was centrifuged at 4000×g for 3 min, the supernatant was discarded, and the thalli were resuspended with fresh LB medium.

2. The above-mentioned bacterial suspensions were diluted and inoculated into 96-well plates with the final concentration of the bacterial suspension being $5×10^5$ CFU/mL per well.

3. Each of the purified human-originated EGF domain proteins (PRT1 to PRT1498 in Table 1) was added to each of the above wells and subjected to two-fold serial dilution in concentration. Three parallel wells were set up for each concentration in the gradient.

4. The above-mentioned 96-well plates were placed and cultured at 37° C. in shaking incubator shaking at 175 rpm. Judgement on MIC: After 10 h of cultivation, the growth was observed with naked eyes or judged under the ultra violet spectrophotometer at a wavelength of 600 nm. The minimal inhibitory concentration MIC is defined as the lowest concentration of the recombinant protein at which there is no growth of the bacteria. The results are shown in Table 3:

TABLE 3

MIC (µg/mL) of the human-originated EGF domain proteins against various Gram-negative bacteria

| | MIC (µg/mL) | | | | | | | | | |
|---|---|---|---|---|---|---|---|---|---|---|
| Protein | E. coli BL21 | P. aeruginosa | K. pneumonia | E. cloacae | A. hydrophila | C. diversus | M. catarrhalis | P. mirabilis | P. vulgaris | S. marcescens |
| PRT1 | 12.5 | 25 | 25 | 12.5 | 12.5 | 12.5 | 25 | 25 | 12.5 | 12.5 |
| PRT2 | 50 | 50 | 50 | 25 | 25 | 25 | 12.5 | 25 | 12.5 | 12.5 |
| PRT3 | 25 | 25 | 12.5 | 12.5 | 25 | 25 | 12.5 | 12.5 | 25 | 12.5 |
| PRT4 | 50 | 25 | 25 | 12.5 | 25 | 12.5 | 25 | 25 | 50 | 25 |
| PRT5 | 12.5 | 25 | 25 | 25 | 12.5 | 25 | 25 | 12.5 | 12.5 | 25 |
| PRT6 | 50 | 25 | 50 | 25 | 12.5 | 25 | 25 | 12.5 | 25 | 25 |
| PRT7 | 25 | 25 | 12.5 | 12.5 | 50 | 12.5 | 25 | 50 | 50 | 12.5 |
| PRT8 | 50 | 12.5 | 25 | 50 | 12.5 | 50 | 12.5 | 12.5 | 25 | 12.5 |
| PRT9 | 25 | 12.5 | 12.5 | 12.5 | 25 | 12.5 | 12.5 | 12.5 | 50 | 12.5 |
| PRT10 | 50 | 12.5 | 50 | 12.5 | 50 | 25 | 12.5 | 12.5 | 25 | 12.5 |
| PRT11 | 25 | 12.5 | 25 | 12.5 | 25 | 50 | 25 | 12.5 | 50 | 25 |
| PRT12 | 25 | 50 | 12.5 | 25 | 12.5 | 12.5 | 12.5 | 25 | 12.5 | 12.5 |
| PRT13 | 12.5 | 12.5 | 25 | 12.5 | 12.5 | 25 | 12.5 | 50 | 25 | 12.5 |
| PRT14 | 50 | 25 | 12.5 | 25 | 50 | 25 | 12.5 | 25 | 50 | 12.5 |
| PRT15 | 50 | 25 | 12.5 | 50 | 12.5 | 25 | 12.5 | 12.5 | 12.5 | 25 |
| PRT16 | 12.5 | 25 | 12.5 | 12.5 | 50 | 25 | 12.5 | 50 | 25 | 25 |
| PRT17 | 12.5 | 12.5 | 25 | 50 | 12.5 | 50 | 25 | 12.5 | 50 | 25 |
| PRT18 | 50 | 25 | 100 | 50 | 25 | 12.5 | 12.5 | 25 | 12.5 | 12.5 |
| PRT19 | 12.5 | 12.5 | 25 | 50 | 12.5 | 25 | 50 | 12.5 | 25 | 50 |
| PRT20 | 25 | 50 | 25 | 12.5 | 50 | 25 | 12.5 | 50 | 25 | 12.5 |
| PRT21 | 50 | 12.5 | 25 | 50 | 12.5 | 25 | 12.5 | 50 | 25 | 50 |
| PRT22 | 50 | 25 | 12.5 | 12.5 | 25 | 12.5 | 25 | 12.5 | 12.5 | 25 |
| PRT23 | 25 | 12.5 | 12.5 | 25 | 12.5 | 50 | 25 | 50 | 25 | 50 |
| PRT24 | 25 | 12.5 | 25 | 12.5 | 12.5 | 25 | 12.5 | 25 | 12.5 | 25 |
| PRT25 | 50 | 25 | 50 | 25 | 12.5 | 100 | 25 | 12.5 | 25 | 12.5 |
| PRT26 | 12.5 | 25 | 12.5 | 25 | 12.5 | 25 | 12.5 | 25 | 12.5 | 25 |
| PRT27 | 25 | 50 | 25 | 12.5 | 25 | 50 | 12.5 | 25 | 50 | 100 |
| PRT28 | 25 | 12.5 | 50 | 25 | 12.5 | 25 | 50 | 12.5 | 25 | 50 |
| PRT29 | 25 | 12.5 | 25 | 50 | 25 | 25 | 12.5 | 25 | 50 | 12.5 |
| PRT30 | 50 | 12.5 | 25 | 50 | 12.5 | 25 | 50 | 12.5 | 25 | 12.5 |
| PRT31 | 12.5 | 12.5 | 25 | 12.5 | 25 | 12.5 | 12.5 | 25 | 50 | 25 |
| PRT32 | 50 | 12.5 | 12.5 | 25 | 50 | 12.5 | 50 | 12.5 | 25 | 50 |
| PRT33 | 50 | 12.5 | 12.5 | 25 | 12.5 | 12.5 | 12.5 | 25 | 25 | 12.5 |
| PRT34 | 25 | 25 | 12.5 | 12.5 | 25 | 25 | 12.5 | 12.5 | 25 | 12.5 |
| PRT35 | 50 | 25 | 12.5 | 50 | 25 | 12.5 | 50 | 12.5 | 25 | 12.5 |
| PRT36 | 25 | 12.5 | 12.5 | 25 | 25 | 50 | 25 | 25 | 12.5 | 25 |
| PRT37 | 50 | 25 | 25 | 12.5 | 12.5 | 25 | 12.5 | 12.5 | 25 | 12.5 |
| PRT38 | 25 | 12.5 | 50 | 25 | 100 | 50 | 12.5 | 25 | 50 | 50 |
| PRT39 | 25 | 50 | 50 | 25 | 50 | 50 | 12.5 | 25 | 12.5 | 12.5 |
| PRT40 | 12.5 | 25 | 12.5 | 25 | 50 | 25 | 12.5 | 12.5 | 25 | 12.5 |
| PRT41 | 12.5 | 25 | 12.5 | 25 | 12.5 | 25 | 12.5 | 25 | 12.5 | 50 |
| PRT42 | 12.5 | 25 | 12.5 | 25 | 12.5 | 25 | 12.5 | 25 | 100 | 50 |
| PRT43 | 25 | 12.5 | 25 | 12.5 | 25 | 12.5 | 25 | 12.5 | 25 | 12.5 |
| PRT44 | 12.5 | 25 | 12.5 | 12.5 | 25 | 25 | 25 | 50 | 25 | 12.5 |
| PRT45 | 25 | 12.5 | 25 | 50 | 25 | 25 | 12.5 | 50 | 12.5 | 50 |
| PRT46 | 12.5 | 50 | 12.5 | 25 | 12.5 | 12.5 | 12.5 | 25 | 12.5 | 100 |
| PRT47 | 25 | 12.5 | 12.5 | 25 | 12.5 | 50 | 25 | 25 | 50 | 12.5 |
| PRT48 | 25 | 12.5 | 50 | 12.5 | 25 | 50 | 12.5 | 25 | 12.5 | 12.5 |
| PRT49 | 25 | 25 | 12.5 | 25 | 25 | 12.5 | 25 | 12.5 | 25 | 100 |
| PRT50 | 12.5 | 25 | 12.5 | 12.5 | 25 | 50 | 25 | 12.5 | 25 | 50 |
| PRT51 | 12.5 | 50 | 25 | 12.5 | 12.5 | 12.5 | 25 | 12.5 | 12.5 | 25 |
| PRT52 | 12.5 | 25 | 12.5 | 25 | 12.5 | 25 | 12.5 | 25 | 50 | 25 |
| PRT53 | 25 | 50 | 12.5 | 50 | 12.5 | 50 | 25 | 12.5 | 100 | 12.5 |
| PRT54 | 12.5 | 25 | 12.5 | 12.5 | 12.5 | 12.5 | 25 | 50 | 25 | 12.5 |
| PRT55 | 50 | 12.5 | 50 | 100 | 12.5 | 12.5 | 25 | 12.5 | 12.5 | 12.5 |
| PRT56 | 12.5 | 12.5 | 100 | 12.5 | 25 | 12.5 | 50 | 25 | 25 | 50 |
| PRT57 | 50 | 12.5 | 50 | 25 | 12.5 | 50 | 12.5 | 25 | 12.5 | 25 |

TABLE 3-continued

MIC (μg/mL) of the human-originated EGF domain proteins against various Gram-negative bacteria

| | MIC (μg/mL) | | | | | | | | | |
|---|---|---|---|---|---|---|---|---|---|---|
| Protein | E. coli BL21 | P. aeruginosa | K. pneumonia | E. cloacae | A. hydrophila | C. diversus | M. catarrhalis | P. mirabilis | P. vulgaris | S. marcescens |
| PRT58 | 25 | 12.5 | 12.5 | 12.5 | 12.5 | 12.5 | 25 | 100 | 25 | 50 |
| PRT59 | 12.5 | 25 | 50 | 25 | 12.5 | 25 | 12.5 | 25 | 12.5 | 12.5 |
| PRT60 | 12.5 | 12.5 | 12.5 | 12.5 | 12.5 | 12.5 | 25 | 50 | 12.5 | 50 |
| PRT61 | 50 | 12.5 | 12.5 | 12.5 | 12.5 | 25 | 25 | 25 | 12.5 | 25 |
| PRT62 | 100 | 12.5 | 12.5 | 12.5 | 25 | 12.5 | 25 | 12.5 | 12.5 | 25 |
| PRT63 | 25 | 12.5 | 25 | 12.5 | 25 | 12.5 | 25 | 12.5 | 25 | 12.5 |
| PRT64 | 12.5 | 50 | 25 | 12.5 | 25 | 50 | 25 | 25 | 25 | 25 |
| PRT65 | 25 | 25 | 25 | 12.5 | 25 | 12.5 | 25 | 12.5 | 25 | 100 |
| PRT66 | 12.5 | 12.5 | 12.5 | 12.5 | 12.5 | 25 | 12.5 | 25 | 12.5 | 25 |
| PRT67 | 50 | 12.5 | 25 | 50 | 25 | 12.5 | 25 | 50 | 12.5 | 50 |
| PRT68 | 25 | 12.5 | 25 | 12.5 | 12.5 | 12.5 | 12.5 | 12.5 | 12.5 | 100 |
| PRT69 | 12.5 | 25 | 12.5 | 25 | 12.5 | 25 | 12.5 | 12.5 | 12.5 | 12.5 |
| PRT70 | 12.5 | 12.5 | 25 | 12.5 | 25 | 12.5 | 12.5 | 50 | 12.5 | 25 |
| PRT71 | 25 | 12.5 | 25 | 50 | 25 | 12.5 | 50 | 12.5 | 12.5 | 12.5 |
| PRT72 | 12.5 | 25 | 12.5 | 25 | 12.5 | 12.5 | 12.5 | 12.5 | 25 | 100 |
| PRT73 | 50 | 25 | 100 | 25 | 50 | 12.5 | 50 | 12.5 | 50 | 12.5 |
| PRT74 | 12.5 | 25 | 50 | 25 | 12.5 | 12.5 | 12.5 | 12.5 | 12.5 | 25 |
| PRT75 | 25 | 12.5 | 25 | 50 | 12.5 | 12.5 | 12.5 | 12.5 | 12.5 | 12.5 |
| PRT76 | 12.5 | 25 | 12.5 | 25 | 12.5 | 25 | 100 | 12.5 | 12.5 | 50 |
| PRT77 | 12.5 | 25 | 50 | 25 | 12.5 | 50 | 12.5 | 50 | 50 | 50 |
| PRT78 | 25 | 50 | 25 | 50 | 25 | 50 | 50 | 50 | 50 | 12.5 |
| PRT79 | 25 | 12.5 | 25 | 12.5 | 25 | 12.5 | 12.5 | 50 | 12.5 | 50 |
| PRT80 | 50 | 12.5 | 25 | 12.5 | 25 | 12.5 | 25 | 12.5 | 12.5 | 12.5 |
| PRT81 | 12.5 | 12.5 | 25 | 12.5 | 25 | 12.5 | 50 | 12.5 | 25 | 50 |
| PRT82 | 12.5 | 25 | 50 | 25 | 12.5 | 50 | 100 | 12.5 | 12.5 | 12.5 |
| PRT83 | 12.5 | 25 | 12.5 | 25 | 12.5 | 25 | 12.5 | 12.5 | 12.5 | 12.5 |
| PRT84 | 25 | 12.5 | 25 | 12.5 | 25 | 12.5 | 25 | 12.5 | 25 | 12.5 |
| PRT85 | 12.5 | 12.5 | 12.5 | 25 | 12.5 | 25 | 50 | 50 | 12.5 | 50 |
| PRT86 | 12.5 | 25 | 12.5 | 25 | 12.5 | 25 | 12.5 | 25 | 12.5 | 12.5 |
| PRT87 | 12.5 | 12.5 | 50 | 12.5 | 25 | 50 | 25 | 12.5 | 25 | 50 |
| PRT88 | 12.5 | 50 | 100 | 12.5 | 12.5 | 12.5 | 12.5 | 50 | 25 | 12.5 |
| PRT89 | 50 | 12.5 | 12.5 | 25 | 50 | 25 | 12.5 | 25 | 50 | 12.5 |
| PRT90 | 12.5 | 12.5 | 12.5 | 12.5 | 12.5 | 25 | 12.5 | 25 | 12.5 | 12.5 |
| PRT91 | 12.5 | 12.5 | 12.5 | 12.5 | 25 | 12.5 | 25 | 12.5 | 50 | 12.5 |
| PRT92 | 12.5 | 50 | 12.5 | 50 | 25 | 12.5 | 25 | 50 | 25 | 12.5 |
| PRT93 | 12.5 | 50 | 12.5 | 12.5 | 25 | 100 | 25 | 12.5 | 12.5 | 12.5 |
| PRT94 | 12.5 | 12.5 | 12.5 | 50 | 12.5 | 50 | 25 | 12.5 | 25 | 50 |
| PRT95 | 12.5 | 50 | 12.5 | 50 | 12.5 | 50 | 12.5 | 25 | 50 | 25 |
| PRT96 | 25 | 12.5 | 12.5 | 12.5 | 12.5 | 12.5 | 12.5 | 12.5 | 25 | 12.5 |
| PRT97 | 12.5 | 25 | 12.5 | 12.5 | 12.5 | 50 | 100 | 50 | 12.5 | 50 |
| PRT98 | 50 | 25 | 12.5 | 25 | 50 | 25 | 100 | 50 | 12.5 | 50 |
| PRT99 | 50 | 12.5 | 50 | 25 | 50 | 25 | 50 | 25 | 50 | 12.5 |
| PRT100 | 12.5 | 12.5 | 12.5 | 12.5 | 12.5 | 12.5 | 12.5 | 12.5 | 25 | 12.5 |
| PRT101 | 50 | 25 | 50 | 25 | 50 | 50 | 50 | 12.5 | 12.5 | 12.5 |
| PRT102 | 12.5 | 12.5 | 12.5 | 12.5 | 12.5 | 25 | 12.5 | 25 | 12.5 | 25 |
| PRT103 | 12.5 | 50 | 12.5 | 12.5 | 12.5 | 12.5 | 12.5 | 25 | 12.5 | 25 |
| PRT104 | 25 | 100 | 12.5 | 12.5 | 12.5 | 12.5 | 12.5 | 12.5 | 12.5 | 25 |
| PRT105 | 25 | 12.5 | 25 | 12.5 | 25 | 50 | 12.5 | 50 | 12.5 | 50 |
| PRT106 | 50 | 12.5 | 50 | 25 | 12.5 | 25 | 12.5 | 12.5 | 12.5 | 12.5 |
| PRT107 | 12.5 | 12.5 | 12.5 | 12.5 | 50 | 25 | 12.5 | 25 | 50 | 12.5 |
| PRT108 | 12.5 | 25 | 50 | 25 | 12.5 | 25 | 50 | 12.5 | 12.5 | 12.5 |
| PRT109 | 12.5 | 12.5 | 12.5 | 12.5 | 12.5 | 12.5 | 25 | 12.5 | 25 | 50 |
| PRT110 | 12.5 | 25 | 50 | 12.5 | 50 | 12.5 | 50 | 12.5 | 12.5 | 12.5 |
| PRT111 | 12.5 | 12.5 | 12.5 | 50 | 25 | 12.5 | 25 | 50 | 25 | 12.5 |
| PRT112 | 12.5 | 50 | 12.5 | 12.5 | 12.5 | 12.5 | 12.5 | 50 | 12.5 | 50 |
| PRT113 | 50 | 25 | 12.5 | 25 | 50 | 12.5 | 50 | 12.5 | 12.5 | 100 |
| PRT114 | 12.5 | 12.5 | 25 | 12.5 | 25 | 12.5 | 12.5 | 12.5 | 12.5 | 12.5 |
| PRT115 | 50 | 12.5 | 50 | 25 | 12.5 | 25 | 50 | 12.5 | 12.5 | 12.5 |
| PRT116 | 12.5 | 25 | 12.5 | 12.5 | 12.5 | 12.5 | 12.5 | 12.5 | 12.5 | 12.5 |
| PRT117 | 12.5 | 25 | 12.5 | 25 | 12.5 | 25 | 12.5 | 25 | 12.5 | 12.5 |
| PRT118 | 12.5 | 12.5 | 12.5 | 12.5 | 12.5 | 12.5 | 25 | 12.5 | 25 | 12.5 |
| PRT119 | 50 | 12.5 | 50 | 25 | 12.5 | 25 | 50 | 25 | 12.5 | 12.5 |
| PRT120 | 12.5 | 12.5 | 12.5 | 12.5 | 12.5 | 12.5 | 100 | 12.5 | 25 | 12.5 |
| PRT121 | 12.5 | 25 | 12.5 | 50 | 12.5 | 50 | 12.5 | 25 | 50 | 25 |
| PRT122 | 12.5 | 12.5 | 12.5 | 12.5 | 12.5 | 12.5 | 25 | 12.5 | 25 | 12.5 |
| PRT123 | 12.5 | 12.5 | 12.5 | 12.5 | 12.5 | 12.5 | 12.5 | 50 | 12.5 | 50 |
| PRT124 | 50 | 12.5 | 50 | 12.5 | 12.5 | 12.5 | 12.5 | 12.5 | 12.5 | 12.5 |
| PRT125 | 12.5 | 12.5 | 12.5 | 12.5 | 50 | 25 | 12.5 | 25 | 50 | 25 |
| PRT126 | 50 | 12.5 | 50 | 12.5 | 12.5 | 12.5 | 100 | 25 | 12.5 | 25 |
| PRT127 | 12.5 | 12.5 | 25 | 12.5 | 25 | 12.5 | 12.5 | 12.5 | 12.5 | 12.5 |
| PRT128 | 25 | 12.5 | 25 | 12.5 | 12.5 | 12.5 | 12.5 | 12.5 | 12.5 | 50 |
| PRT129 | 12.5 | 50 | 12.5 | 50 | 25 | 12.5 | 25 | 25 | 12.5 | 12.5 |
| PRT130 | 25 | 12.5 | 25 | 12.5 | 25 | 50 | 25 | 12.5 | 50 | 12.5 |

TABLE 3-continued

MIC (µg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT131 | 12.5 | 12.5 | 12.5 | 12.5 | 12.5 | 12.5 | 25 | 100 | 25 | 12.5 |
| PRT132 | 12.5 | 12.5 | 12.5 | 25 | 50 | 25 | 12.5 | 25 | 50 | 12.5 |
| PRT133 | 12.5 | 50 | 25 | 12.5 | 25 | 50 | 25 | 12.5 | 50 | 12.5 |
| PRT134 | 12.5 | 12.5 | 25 | 12.5 | 25 | 25 | 12.5 | 100 | 25 | 12.5 |
| PRT135 | 12.5 | 25 | 12.5 | 25 | 12.5 | 25 | 50 | 25 | 12.5 | 50 |
| PRT136 | 50 | 12.5 | 25 | 25 | 50 | 12.5 | 12.5 | 25 | 12.5 | 25 |
| PRT137 | 12.5 | 25 | 12.5 | 25 | 12.5 | 25 | 12.5 | 25 | 12.5 | 50 |
| PRT138 | 50 | 12.5 | 25 | 50 | 25 | 12.5 | 100 | 12.5 | 12.5 | 25 |
| PRT139 | 25 | 12.5 | 25 | 12.5 | 12.5 | 12.5 | 50 | 12.5 | 50 | 12.5 |
| PRT140 | 25 | 12.5 | 25 | 12.5 | 25 | 12.5 | 12.5 | 12.5 | 12.5 | 12.5 |
| PRT141 | 25 | 12.5 | 25 | 12.5 | 25 | 50 | 12.5 | 50 | 12.5 | 50 |
| PRT142 | 12.5 | 25 | 12.5 | 25 | 25 | 12.5 | 25 | 12.5 | 25 | 12.5 |
| PRT143 | 12.5 | 12.5 | 12.5 | 12.5 | 12.5 | 12.5 | 50 | 25 | 12.5 | 25 |
| PRT144 | 50 | 12.5 | 50 | 12.5 | 50 | 25 | 12.5 | 25 | 50 | 12.5 |
| PRT145 | 12.5 | 12.5 | 12.5 | 12.5 | 12.5 | 12.5 | 12.5 | 25 | 12.5 | 25 |
| PRT146 | 50 | 12.5 | 50 | 12.5 | 12.5 | 25 | 12.5 | 25 | 12.5 | 25 |
| PRT147 | 12.5 | 12.5 | 12.5 | 12.5 | 12.5 | 12.5 | 12.5 | 12.5 | 25 | 12.5 |
| PRT148 | 50 | 25 | 12.5 | 50 | 12.5 | 50 | 12.5 | 50 | 12.5 | 50 |
| PRT149 | 12.5 | 12.5 | 25 | 12.5 | 25 | 12.5 | 25 | 12.5 | 12.5 | 12.5 |
| PRT150 | 12.5 | 25 | 25 | 12.5 | 50 | 25 | 12.5 | 25 | 25 | 50 |
| PRT151 | 50 | 12.5 | 50 | 12.5 | 50 | 25 | 12.5 | 25 | 50 | 12.5 |
| PRT152 | 12.5 | 12.5 | 12.5 | 12.5 | 12.5 | 25 | 12.5 | 25 | 12.5 | 12.5 |
| PRT153 | 100 | 50 | 12.5 | 25 | 50 | 25 | 12.5 | 50 | 12.5 | 50 |
| PRT154 | 50 | 12.5 | 25 | 50 | 12.5 | 25 | 50 | 25 | 12.5 | 25 |
| PRT155 | 25 | 12.5 | 25 | 12.5 | 25 | 12.5 | 25 | 12.5 | 25 | 12.5 |
| PRT156 | 12.5 | 12.5 | 25 | 12.5 | 25 | 12.5 | 50 | 12.5 | 50 | 50 |
| PRT157 | 50 | 25 | 12.5 | 25 | 12.5 | 12.5 | 12.5 | 12.5 | 12.5 | 12.5 |
| PRT158 | 12.5 | 50 | 12.5 | 50 | 25 | 12.5 | 25 | 50 | 25 | 12.5 |
| PRT159 | 50 | 25 | 12.5 | 12.5 | 12.5 | 12.5 | 12.5 | 25 | 12.5 | 25 |
| PRT160 | 25 | 12.5 | 25 | 25 | 25 | 12.5 | 25 | 12.5 | 25 | 12.5 |
| PRT161 | 12.5 | 25 | 12.5 | 25 | 50 | 25 | 12.5 | 25 | 50 | 25 |
| PRT162 | 25 | 12.5 | 25 | 12.5 | 25 | 12.5 | 12.5 | 100 | 12.5 | 25 |
| PRT163 | 25 | 12.5 | 25 | 12.5 | 25 | 12.5 | 25 | 50 | 25 | 12.5 |
| PRT164 | 50 | 25 | 12.5 | 25 | 50 | 12.5 | 50 | 12.5 | 50 | 12.5 |
| PRT165 | 12.5 | 25 | 12.5 | 25 | 25 | 25 | 25 | 12.5 | 25 | 12.5 |
| PRT166 | 25 | 12.5 | 25 | 12.5 | 12.5 | 12.5 | 12.5 | 12.5 | 12.5 | 50 |
| PRT167 | 50 | 12.5 | 50 | 12.5 | 12.5 | 25 | 12.5 | 25 | 25 | 12.5 |
| PRT168 | 25 | 12.5 | 25 | 12.5 | 50 | 12.5 | 50 | 12.5 | 50 | 12.5 |
| PRT169 | 12.5 | 50 | 100 | 50 | 25 | 12.5 | 25 | 50 | 25 | 12.5 |
| PRT170 | 25 | 12.5 | 25 | 50 | 25 | 12.5 | 25 | 50 | 25 | 12.5 |
| PRT171 | 50 | 25 | 12.5 | 25 | 50 | 25 | 12.5 | 25 | 50 | 25 |
| PRT172 | 25 | 50 | 25 | 12.5 | 12.5 | 12.5 | 12.5 | 12.5 | 12.5 | 12.5 |
| PRT173 | 50 | 12.5 | 50 | 25 | 12.5 | 25 | 50 | 25 | 12.5 | 25 |
| PRT174 | 12.5 | 25 | 50 | 25 | 12.5 | 25 | 50 | 12.5 | 50 | 12.5 |
| PRT175 | 12.5 | 12.5 | 12.5 | 12.5 | 25 | 12.5 | 25 | 12.5 | 25 | 12.5 |
| PRT176 | 12.5 | 25 | 12.5 | 25 | 12.5 | 25 | 50 | 25 | 12.5 | 25 |
| PRT177 | 25 | 12.5 | 25 | 50 | 25 | 12.5 | 25 | 50 | 25 | 12.5 |
| PRT178 | 50 | 25 | 12.5 | 50 | 12.5 | 50 | 12.5 | 50 | 12.5 | 25 |
| PRT179 | 25 | 12.5 | 25 | 50 | 12.5 | 25 | 12.5 | 25 | 12.5 | 12.5 |
| PRT180 | 12.5 | 12.5 | 12.5 | 50 | 25 | 12.5 | 25 | 50 | 25 | 12.5 |
| PRT181 | 50 | 25 | 12.5 | 25 | 50 | 25 | 12.5 | 25 | 50 | 25 |
| PRT182 | 12.5 | 25 | 12.5 | 25 | 12.5 | 25 | 100 | 25 | 12.5 | 25 |
| PRT183 | 12.5 | 12.5 | 25 | 12.5 | 25 | 12.5 | 25 | 12.5 | 25 | 12.5 |
| PRT184 | 12.5 | 25 | 50 | 25 | 12.5 | 25 | 50 | 25 | 12.5 | 25 |
| PRT185 | 25 | 12.5 | 25 | 50 | 25 | 12.5 | 50 | 12.5 | 12.5 | 50 |
| PRT186 | 50 | 12.5 | 25 | 50 | 25 | 12.5 | 25 | 12.5 | 25 | 12.5 |
| PRT187 | 12.5 | 25 | 12.5 | 25 | 12.5 | 25 | 12.5 | 25 | 12.5 | 25 |
| PRT188 | 12.5 | 50 | 12.5 | 50 | 12.5 | 12.5 | 25 | 12.5 | 25 | 12.5 |
| PRT189 | 12.5 | 25 | 12.5 | 25 | 50 | 25 | 12.5 | 25 | 50 | 25 |
| PRT190 | 25 | 50 | 25 | 12.5 | 25 | 12.5 | 12.5 | 12.5 | 12.5 | 12.5 |
| PRT191 | 12.5 | 12.5 | 12.5 | 25 | 12.5 | 25 | 12.5 | 12.5 | 50 | 12.5 |
| PRT192 | 50 | 25 | 12.5 | 25 | 50 | 25 | 12.5 | 25 | 50 | 12.5 |
| PRT193 | 100 | 50 | 12.5 | 12.5 | 12.5 | 25 | 12.5 | 25 | 12.5 | 25 |
| PRT194 | 25 | 12.5 | 25 | 12.5 | 12.5 | 12.5 | 100 | 100 | 25 | 12.5 |
| PRT195 | 12.5 | 50 | 50 | 12.5 | 50 | 12.5 | 25 | 50 | 25 | 12.5 |
| PRT196 | 12.5 | 25 | 12.5 | 25 | 12.5 | 25 | 50 | 25 | 12.5 | 25 |
| PRT197 | 12.5 | 50 | 12.5 | 50 | 12.5 | 12.5 | 12.5 | 12.5 | 12.5 | 12.5 |
| PRT198 | 12.5 | 12.5 | 50 | 12.5 | 25 | 50 | 25 | 12.5 | 25 | 50 |
| PRT199 | 12.5 | 12.5 | 12.5 | 12.5 | 12.5 | 12.5 | 12.5 | 12.5 | 12.5 | 25 |
| PRT200 | 25 | 50 | 25 | 12.5 | 25 | 50 | 25 | 12.5 | 50 | 12.5 |
| PRT201 | 12.5 | 50 | 12.5 | 50 | 12.5 | 50 | 12.5 | 25 | 50 | 25 |
| PRT202 | 12.5 | 12.5 | 12.5 | 12.5 | 12.5 | 12.5 | 12.5 | 25 | 12.5 | 25 |
| PRT203 | 25 | 12.5 | 25 | 12.5 | 25 | 50 | 25 | 50 | 25 | 50 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT204 | 12.5 | 50 | 50 | 50 | 12.5 | 12.5 | 12.5 | 12.5 | 12.5 | 12.5 |
| PRT205 | 12.5 | 12.5 | 25 | 12.5 | 25 | 12.5 | 25 | 12.5 | 25 | 12.5 |
| PRT206 | 50 | 25 | 12.5 | 25 | 50 | 25 | 12.5 | 50 | 12.5 | 50 |
| PRT207 | 50 | 12.5 | 50 | 12.5 | 50 | 12.5 | 50 | 12.5 | 25 | 50 |
| PRT208 | 50 | 25 | 12.5 | 25 | 12.5 | 25 | 12.5 | 25 | 12.5 | 25 |
| PRT209 | 12.5 | 12.5 | 25 | 12.5 | 12.5 | 12.5 | 12.5 | 12.5 | 50 | 12.5 |
| PRT210 | 12.5 | 12.5 | 12.5 | 12.5 | 12.5 | 12.5 | 12.5 | 12.5 | 25 | 12.5 |
| PRT211 | 12.5 | 25 | 12.5 | 25 | 50 | 25 | 12.5 | 25 | 50 | 25 |
| PRT212 | 50 | 12.5 | 50 | 12.5 | 25 | 12.5 | 25 | 12.5 | 12.5 | 12.5 |
| PRT213 | 12.5 | 12.5 | 12.5 | 50 | 12.5 | 50 | 12.5 | 25 | 50 | 25 |
| PRT214 | 25 | 12.5 | 25 | 12.5 | 25 | 12.5 | 25 | 12.5 | 25 | 12.5 |
| PRT215 | 12.5 | 25 | 100 | 25 | 12.5 | 25 | 12.5 | 25 | 12.5 | 12.5 |
| PRT216 | 12.5 | 12.5 | 50 | 12.5 | 50 | 12.5 | 50 | 25 | 12.5 | 25 |
| PRT217 | 25 | 12.5 | 25 | 12.5 | 25 | 12.5 | 12.5 | 12.5 | 12.5 | 50 |
| PRT218 | 50 | 50 | 50 | 25 | 12.5 | 25 | 50 | 25 | 50 | 25 |
| PRT219 | 25 | 50 | 12.5 | 12.5 | 12.5 | 12.5 | 12.5 | 12.5 | 25 | 12.5 |
| PRT220 | 25 | 12.5 | 25 | 12.5 | 25 | 12.5 | 12.5 | 12.5 | 12.5 | 50 |
| PRT221 | 50 | 50 | 12.5 | 25 | 50 | 25 | 12.5 | 25 | 50 | 12.5 |
| PRT222 | 12.5 | 12.5 | 12.5 | 25 | 12.5 | 25 | 12.5 | 25 | 12.5 | 25 |
| PRT223 | 25 | 12.5 | 25 | 12.5 | 25 | 12.5 | 25 | 12.5 | 25 | 12.5 |
| PRT224 | 12.5 | 25 | 12.5 | 12.5 | 12.5 | 12.5 | 12.5 | 12.5 | 12.5 | 50 |
| PRT225 | 50 | 12.5 | 50 | 25 | 12.5 | 25 | 50 | 25 | 12.5 | 25 |
| PRT226 | 25 | 12.5 | 25 | 50 | 12.5 | 50 | 12.5 | 12.5 | 12.5 | 12.5 |
| PRT227 | 12.5 | 12.5 | 12.5 | 12.5 | 12.5 | 50 | 25 | 12.5 | 25 | 50 |
| PRT228 | 12.5 | 25 | 50 | 25 | 12.5 | 25 | 50 | 25 | 12.5 | 25 |
| PRT229 | 25 | 12.5 | 12.5 | 12.5 | 12.5 | 12.5 | 12.5 | 12.5 | 25 | 12.5 |
| PRT230 | 12.5 | 25 | 12.5 | 25 | 12.5 | 25 | 12.5 | 50 | 12.5 | 50 |
| PRT231 | 50 | 12.5 | 50 | 12.5 | 25 | 12.5 | 25 | 12.5 | 25 | 12.5 |
| PRT232 | 12.5 | 25 | 12.5 | 25 | 12.5 | 25 | 12.5 | 25 | 12.5 | 25 |
| PRT233 | 25 | 12.5 | 25 | 12.5 | 25 | 12.5 | 25 | 100 | 25 | 12.5 |
| PRT234 | 50 | 25 | 12.5 | 25 | 12.5 | 25 | 12.5 | 25 | 12.5 | 25 |
| PRT235 | 25 | 12.5 | 25 | 12.5 | 25 | 12.5 | 12.5 | 12.5 | 12.5 | 12.5 |
| PRT236 | 12.5 | 100 | 12.5 | 12.5 | 25 | 12.5 | 25 | 12.5 | 25 | 12.5 |
| PRT237 | 12.5 | 25 | 12.5 | 25 | 12.5 | 25 | 12.5 | 25 | 25 | 50 |
| PRT238 | 12.5 | 25 | 50 | 25 | 12.5 | 25 | 12.5 | 12.5 | 25 | 12.5 |
| PRT239 | 12.5 | 12.5 | 12.5 | 12.5 | 12.5 | 100 | 25 | 12.5 | 12.5 | 12.5 |
| PRT240 | 12.5 | 25 | 12.5 | 25 | 12.5 | 25 | 12.5 | 100 | 100 | 12.5 |
| PRT241 | 12.5 | 12.5 | 12.5 | 12.5 | 12.5 | 12.5 | 25 | 12.5 | 25 | 50 |
| PRT242 | 12.5 | 50 | 50 | 12.5 | 12.5 | 12.5 | 12.5 | 12.5 | 12.5 | 12.5 |
| PRT243 | 12.5 | 12.5 | 12.5 | 12.5 | 25 | 12.5 | 25 | 12.5 | 25 | 12.5 |
| PRT244 | 12.5 | 12.5 | 12.5 | 12.5 | 25 | 12.5 | 25 | 12.5 | 25 | 12.5 |
| PRT245 | 50 | 12.5 | 12.5 | 12.5 | 12.5 | 25 | 12.5 | 25 | 12.5 | 25 |
| PRT246 | 12.5 | 12.5 | 12.5 | 12.5 | 12.5 | 12.5 | 25 | 12.5 | 25 | 12.5 |
| PRT247 | 12.5 | 12.5 | 12.5 | 25 | 12.5 | 25 | 100 | 25 | 12.5 | 25 |
| PRT248 | 25 | 12.5 | 25 | 12.5 | 25 | 12.5 | 25 | 12.5 | 25 | 12.5 |
| PRT249 | 12.5 | 12.5 | 12.5 | 25 | 12.5 | 25 | 12.5 | 12.5 | 12.5 | 12.5 |
| PRT250 | 12.5 | 12.5 | 12.5 | 12.5 | 25 | 12.5 | 25 | 12.5 | 25 | 12.5 |
| PRT251 | 12.5 | 25 | 12.5 | 25 | 12.5 | 25 | 12.5 | 12.5 | 12.5 | 12.5 |
| PRT252 | 12.5 | 25 | 12.5 | 25 | 12.5 | 25 | 12.5 | 25 | 12.5 | 25 |
| PRT253 | 25 | 12.5 | 25 | 12.5 | 25 | 12.5 | 25 | 12.5 | 25 | 12.5 |
| PRT254 | 12.5 | 12.5 | 12.5 | 12.5 | 25 | 12.5 | 25 | 12.5 | 12.5 | 12.5 |
| PRT255 | 12.5 | 12.5 | 12.5 | 12.5 | 25 | 12.5 | 25 | 100 | 25 | 12.5 |
| PRT256 | 12.5 | 25 | 12.5 | 25 | 12.5 | 25 | 12.5 | 25 | 12.5 | 25 |
| PRT257 | 25 | 12.5 | 25 | 12.5 | 25 | 12.5 | 25 | 12.5 | 12.5 | 12.5 |
| PRT258 | 12.5 | 50 | 12.5 | 50 | 12.5 | 25 | 12.5 | 25 | 50 | 25 |
| PRT259 | 25 | 50 | 12.5 | 50 | 12.5 | 50 | 12.5 | 25 | 50 | 25 |
| PRT260 | 25 | 50 | 25 | 12.5 | 25 | 50 | 25 | 12.5 | 12.5 | 12.5 |
| PRT261 | 12.5 | 12.5 | 12.5 | 50 | 12.5 | 25 | 50 | 25 | 12.5 | 50 |
| PRT262 | 25 | 50 | 25 | 12.5 | 25 | 50 | 25 | 12.5 | 25 | 12.5 |
| PRT263 | 25 | 12.5 | 25 | 12.5 | 25 | 12.5 | 12.5 | 12.5 | 12.5 | 50 |
| PRT264 | 50 | 12.5 | 50 | 12.5 | 25 | 50 | 25 | 12.5 | 25 | 12.5 |
| PRT265 | 12.5 | 25 | 12.5 | 25 | 12.5 | 25 | 25 | 25 | 50 | 25 |
| PRT266 | 25 | 50 | 25 | 12.5 | 25 | 50 | 25 | 12.5 | 50 | 12.5 |
| PRT267 | 100 | 50 | 12.5 | 50 | 12.5 | 50 | 12.5 | 25 | 50 | 25 |
| PRT268 | 25 | 12.5 | 25 | 50 | 25 | 12.5 | 25 | 50 | 12.5 | 12.5 |
| PRT269 | 12.5 | 12.5 | 12.5 | 12.5 | 50 | 12.5 | 50 | 25 | 12.5 | 25 |
| PRT270 | 25 | 12.5 | 25 | 12.5 | 25 | 12.5 | 12.5 | 12.5 | 12.5 | 12.5 |
| PRT271 | 50 | 12.5 | 50 | 12.5 | 50 | 12.5 | 50 | 12.5 | 25 | 50 |
| PRT272 | 12.5 | 12.5 | 12.5 | 12.5 | 25 | 12.5 | 25 | 12.5 | 25 | 50 |
| PRT273 | 50 | 12.5 | 50 | 25 | 12.5 | 25 | 50 | 12.5 | 12.5 | 25 |
| PRT274 | 25 | 12.5 | 25 | 12.5 | 25 | 12.5 | 25 | 12.5 | 25 | 12.5 |
| PRT275 | 12.5 | 25 | 50 | 25 | 12.5 | 50 | 12.5 | 50 | 12.5 | 50 |
| PRT276 | 50 | 12.5 | 50 | 25 | 12.5 | 25 | 12.5 | 25 | 12.5 | 25 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT277 | 12.5 | 25 | 12.5 | 25 | 12.5 | 25 | 50 | 12.5 | 50 | 12.5 |
| PRT278 | 12.5 | 50 | 12.5 | 50 | 100 | 50 | 25 | 12.5 | 25 | 12.5 |
| PRT279 | 12.5 | 50 | 25 | 12.5 | 25 | 50 | 12.5 | 50 | 12.5 | 50 |
| PRT280 | 50 | 12.5 | 25 | 50 | 25 | 12.5 | 50 | 12.5 | 50 | 12.5 |
| PRT281 | 12.5 | 12.5 | 25 | 12.5 | 25 | 12.5 | 12.5 | 12.5 | 12.5 | 50 |
| PRT282 | 50 | 12.5 | 12.5 | 25 | 12.5 | 25 | 12.5 | 12.5 | 12.5 | 12.5 |
| PRT283 | 12.5 | 50 | 25 | 12.5 | 25 | 50 | 25 | 12.5 | 50 | 12.5 |
| PRT284 | 12.5 | 50 | 12.5 | 25 | 50 | 25 | 12.5 | 25 | 12.5 | 25 |
| PRT285 | 100 | 50 | 12.5 | 50 | 12.5 | 25 | 50 | 25 | 12.5 | 25 |
| PRT286 | 25 | 25 | 50 | 12.5 | 50 | 12.5 | 12.5 | 50 | 12.5 | 50 |
| PRT287 | 50 | 12.5 | 50 | 12.5 | 25 | 12.5 | 25 | 12.5 | 12.5 | 12.5 |
| PRT288 | 12.5 | 12.5 | 12.5 | 50 | 12.5 | 25 | 50 | 25 | 12.5 | 12.5 |
| PRT289 | 12.5 | 50 | 12.5 | 50 | 12.5 | 50 | 12.5 | 50 | 25 | 12.5 |
| PRT290 | 12.5 | 50 | 12.5 | 12.5 | 12.5 | 25 | 12.5 | 25 | 12.5 | 25 |
| PRT291 | 12.5 | 12.5 | 12.5 | 12.5 | 25 | 50 | 25 | 12.5 | 50 | 12.5 |
| PRT292 | 12.5 | 50 | 25 | 12.5 | 25 | 50 | 100 | 50 | 12.5 | 25 |
| PRT293 | 25 | 50 | 25 | 12.5 | 25 | 50 | 12.5 | 50 | 12.5 | 50 |
| PRT294 | 50 | 25 | 12.5 | 25 | 50 | 12.5 | 50 | 12.5 | 50 | 12.5 |
| PRT295 | 50 | 12.5 | 50 | 12.5 | 25 | 50 | 25 | 12.5 | 50 | 12.5 |
| PRT296 | 12.5 | 12.5 | 12.5 | 12.5 | 12.5 | 12.5 | 25 | 12.5 | 25 | 12.5 |
| PRT297 | 12.5 | 50 | 12.5 | 50 | 12.5 | 50 | 12.5 | 50 | 25 | 12.5 |
| PRT298 | 50 | 12.5 | 50 | 12.5 | 50 | 12.5 | 50 | 12.5 | 25 | 50 |
| PRT299 | 12.5 | 50 | 12.5 | 50 | 12.5 | 50 | 12.5 | 12.5 | 12.5 | 25 |
| PRT300 | 25 | 12.5 | 12.5 | 12.5 | 12.5 | 12.5 | 25 | 12.5 | 25 | 12.5 |
| PRT301 | 12.5 | 50 | 25 | 12.5 | 25 | 50 | 12.5 | 50 | 12.5 | 12.5 |
| PRT302 | 25 | 12.5 | 25 | 12.5 | 12.5 | 12.5 | 12.5 | 12.5 | 50 | 12.5 |
| PRT303 | 25 | 12.5 | 25 | 50 | 12.5 | 50 | 12.5 | 50 | 100 | 50 |
| PRT304 | 50 | 12.5 | 25 | 50 | 25 | 12.5 | 25 | 50 | 12.5 | 50 |
| PRT305 | 50 | 12.5 | 50 | 12.5 | 25 | 50 | 25 | 12.5 | 50 | 12.5 |
| PRT306 | 25 | 12.5 | 25 | 12.5 | 25 | 12.5 | 12.5 | 50 | 12.5 | 50 |
| PRT307 | 12.5 | 25 | 12.5 | 25 | 12.5 | 12.5 | 12.5 | 12.5 | 12.5 | 50 |
| PRT308 | 50 | 12.5 | 50 | 25 | 12.5 | 25 | 50 | 12.5 | 25 | 50 |
| PRT309 | 12.5 | 25 | 50 | 25 | 12.5 | 25 | 50 | 25 | 12.5 | 25 |
| PRT310 | 25 | 12.5 | 25 | 50 | 25 | 12.5 | 25 | 50 | 12.5 | 50 |
| PRT311 | 25 | 50 | 25 | 12.5 | 50 | 12.5 | 50 | 25 | 12.5 | 25 |
| PRT312 | 12.5 | 50 | 25 | 12.5 | 25 | 50 | 25 | 12.5 | 25 | 50 |
| PRT313 | 12.5 | 50 | 25 | 12.5 | 25 | 50 | 100 | 50 | 12.5 | 50 |
| PRT314 | 50 | 25 | 12.5 | 25 | 50 | 25 | 12.5 | 50 | 12.5 | 50 |
| PRT315 | 50 | 12.5 | 50 | 12.5 | 50 | 12.5 | 50 | 12.5 | 50 | 12.5 |
| PRT316 | 12.5 | 50 | 12.5 | 50 | 12.5 | 50 | 12.5 | 50 | 12.5 | 50 |
| PRT317 | 50 | 12.5 | 50 | 12.5 | 25 | 12.5 | 25 | 12.5 | 12.5 | 12.5 |
| PRT318 | 12.5 | 12.5 | 50 | 12.5 | 50 | 12.5 | 50 | 12.5 | 25 | 50 |
| PRT319 | 12.5 | 12.5 | 12.5 | 12.5 | 50 | 12.5 | 25 | 50 | 25 | 12.5 |
| PRT320 | 12.5 | 50 | 25 | 12.5 | 25 | 12.5 | 50 | 12.5 | 50 | 12.5 |
| PRT321 | 12.5 | 50 | 12.5 | 50 | 25 | 100 | 25 | 50 | 25 | 12.5 |
| PRT322 | 50 | 25 | 12.5 | 50 | 12.5 | 50 | 12.5 | 50 | 12.5 | 50 |
| PRT323 | 12.5 | 25 | 50 | 12.5 | 50 | 12.5 | 50 | 12.5 | 25 | 50 |
| PRT324 | 25 | 12.5 | 25 | 50 | 25 | 50 | 50 | 12.5 | 50 | 12.5 |
| PRT325 | 12.5 | 50 | 12.5 | 50 | 12.5 | 25 | 50 | 25 | 12.5 | 25 |
| PRT326 | 25 | 12.5 | 25 | 50 | 25 | 12.5 | 25 | 50 | 25 | 12.5 |
| PRT327 | 12.5 | 12.5 | 12.5 | 12.5 | 12.5 | 50 | 12.5 | 50 | 12.5 | 50 |
| PRT328 | 50 | 12.5 | 50 | 100 | 50 | 12.5 | 50 | 12.5 | 12.5 | 50 |
| PRT329 | 12.5 | 25 | 50 | 25 | 12.5 | 50 | 12.5 | 50 | 12.5 | 50 |
| PRT330 | 50 | 12.5 | 50 | 25 | 12.5 | 25 | 50 | 25 | 12.5 | 25 |
| PRT331 | 12.5 | 50 | 12.5 | 50 | 12.5 | 50 | 12.5 | 50 | 12.5 | 50 |
| PRT332 | 12.5 | 25 | 50 | 25 | 50 | 25 | 50 | 12.5 | 12.5 | 12.5 |
| PRT333 | 12.5 | 12.5 | 12.5 | 12.5 | 12.5 | 12.5 | 25 | 12.5 | 25 | 25 |
| PRT334 | 25 | 12.5 | 25 | 12.5 | 12.5 | 12.5 | 12.5 | 12.5 | 12.5 | 12.5 |
| PRT335 | 12.5 | 12.5 | 12.5 | 12.5 | 50 | 25 | 50 | 25 | 12.5 | 25 |
| PRT336 | 25 | 12.5 | 50 | 12.5 | 50 | 12.5 | 50 | 12.5 | 50 | 12.5 |
| PRT337 | 12.5 | 50 | 50 | 12.5 | 50 | 12.5 | 50 | 12.5 | 50 | 12.5 |
| PRT338 | 12.5 | 50 | 12.5 | 50 | 25 | 12.5 | 25 | 50 | 25 | 12.5 |
| PRT339 | 12.5 | 12.5 | 12.5 | 12.5 | 12.5 | 12.5 | 50 | 12.5 | 50 | 12.5 |
| PRT340 | 50 | 25 | 12.5 | 25 | 50 | 25 | 12.5 | 25 | 50 | 12.5 |
| PRT341 | 12.5 | 50 | 12.5 | 50 | 12.5 | 50 | 25 | 12.5 | 50 | 12.5 |
| PRT342 | 100 | 25 | 25 | 50 | 12.5 | 50 | 12.5 | 50 | 12.5 | 12.5 |
| PRT343 | 25 | 25 | 12.5 | 12.5 | 12.5 | 12.5 | 12.5 | 12.5 | 12.5 | 12.5 |
| PRT344 | 12.5 | 50 | 12.5 | 50 | 12.5 | 50 | 12.5 | 50 | 12.5 | 50 |
| PRT345 | 50 | 12.5 | 50 | 12.5 | 50 | 12.5 | 50 | 12.5 | 50 | 12.5 |
| PRT346 | 12.5 | 12.5 | 12.5 | 50 | 25 | 50 | 12.5 | 50 | 12.5 | 12.5 |
| PRT347 | 12.5 | 50 | 25 | 12.5 | 50 | 50 | 12.5 | 50 | 12.5 | 12.5 |
| PRT348 | 12.5 | 12.5 | 12.5 | 12.5 | 5 | 50 | 12.5 | 50 | 50 | 50 |
| PRT349 | 50 | 25 | 25 | 50 | 50 | 12.5 | 50 | 12.5 | 25 | 50 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT350 | 12.5 | 50 | 12.5 | 50 | 12.5 | 50 | 25 | 50 | 12.5 | 50 |
| PRT351 | 50 | 12.5 | 25 | 50 | 25 | 50 | 50 | 12.5 | 50 | 25 |
| PRT352 | 25 | 12.5 | 12.5 | 25 | 12.5 | 12.5 | 25 | 12.5 | 12.5 | 12.5 |
| PRT353 | 12.5 | 50 | 25 | 12.5 | 25 | 50 | 12.5 | 50 | 12.5 | 25 |
| PRT354 | 12.5 | 50 | 12.5 | 50 | 12.5 | 50 | 12.5 | 25 | 50 | 50 |
| PRT355 | 50 | 25 | 12.5 | 25 | 25 | 25 | 50 | 12.5 | 50 | 25 |
| PRT356 | 12.5 | 50 | 12.5 | 50 | 25 | 12.5 | 25 | 50 | 12.5 | 25 |
| PRT357 | 12.5 | 50 | 25 | 12.5 | 25 | 50 | 12.5 | 50 | 12.5 | 50 |
| PRT358 | 12.5 | 50 | 12.5 | 12.5 | 12.5 | 12.5 | 25 | 12.5 | 50 | 50 |
| PRT359 | 25 | 50 | 25 | 12.5 | 25 | 50 | 25 | 12.5 | 50 | 12.5 |
| PRT360 | 12.5 | 50 | 12.5 | 50 | 12.5 | 50 | 12.5 | 12.5 | 25 | 25 |
| PRT361 | 25 | 25 | 25 | 50 | 12.5 | 50 | 12.5 | 50 | 100 | 50 |
| PRT362 | 12.5 | 25 | 50 | 25 | 12.5 | 25 | 12.5 | 12.5 | 12.5 | 12.5 |
| PRT363 | 25 | 12.5 | 50 | 25 | 12.5 | 50 | 12.5 | 50 | 12.5 | 50 |
| PRT364 | 12.5 | 12.5 | 12.5 | 50 | 12.5 | 50 | 12.5 | 25 | 50 | 25 |
| PRT365 | 25 | 50 | 25 | 12.5 | 25 | 50 | 25 | 12.5 | 12.5 | 50 |
| PRT366 | 50 | 12.5 | 50 | 12.5 | 50 | 12.5 | 25 | 50 | 25 | 12.5 |
| PRT367 | 25 | 50 | 25 | 12.5 | 25 | 12.5 | 12.5 | 50 | 12.5 | 50 |
| PRT368 | 50 | 12.5 | 50 | 12.5 | 50 | 12.5 | 50 | 25 | 12.5 | 25 |
| PRT369 | 25 | 12.5 | 50 | 25 | 12.5 | 25 | 50 | 12.5 | 50 | 12.5 |
| PRT370 | 12.5 | 50 | 12.5 | 50 | 25 | 12.5 | 25 | 50 | 25 | 12.5 |
| PRT371 | 12.5 | 50 | 12.5 | 50 | 12.5 | 50 | 12.5 | 50 | 12.5 | 50 |
| PRT372 | 50 | 12.5 | 25 | 50 | 25 | 12.5 | 50 | 12.5 | 50 | 12.5 |
| PRT373 | 12.5 | 50 | 12.5 | 50 | 50 | 12.5 | 50 | 12.5 | 25 | 50 |
| PRT374 | 12.5 | 50 | 12.5 | 50 | 12.5 | 50 | 12.5 | 50 | 12.5 | 50 |
| PRT375 | 50 | 12.5 | 50 | 12.5 | 50 | 12.5 | 50 | 12.5 | 50 | 12.5 |
| PRT376 | 12.5 | 50 | 12.5 | 50 | 12.5 | 50 | 12.5 | 50 | 12.5 | 50 |
| PRT377 | 25 | 12.5 | 25 | 50 | 25 | 12.5 | 25 | 50 | 25 | 12.5 |
| PRT378 | 12.5 | 25 | 50 | 25 | 12.5 | 25 | 50 | 25 | 12.5 | 50 |
| PRT379 | 50 | 12.5 | 50 | 12.5 | 50 | 100 | 50 | 12.5 | 50 | 12.5 |
| PRT380 | 12.5 | 50 | 12.5 | 50 | 12.5 | 50 | 12.5 | 25 | 50 | 25 |
| PRT381 | 50 | 12.5 | 50 | 12.5 | 50 | 12.5 | 50 | 25 | 12.5 | 25 |
| PRT382 | 12.5 | 50 | 12.5 | 50 | 12.5 | 50 | 12.5 | 50 | 25 | 12.5 |
| PRT383 | 50 | 12.5 | 50 | 12.5 | 25 | 50 | 25 | 12.5 | 50 | 12.5 |
| PRT384 | 12.5 | 50 | 25 | 12.5 | 25 | 50 | 25 | 12.5 | 25 | 50 |
| PRT385 | 12.5 | 25 | 50 | 25 | 12.5 | 25 | 50 | 12.5 | 25 | 50 |
| PRT386 | 12.5 | 50 | 12.5 | 50 | 100 | 50 | 12.5 | 50 | 12.5 | 50 |
| PRT387 | 50 | 25 | 12.5 | 25 | 50 | 25 | 12.5 | 25 | 50 | 25 |
| PRT388 | 50 | 12.5 | 12.5 | 50 | 12.5 | 50 | 12.5 | 25 | 50 | 25 |
| PRT389 | 25 | 50 | 25 | 12.5 | 25 | 50 | 25 | 12.5 | 25 | 50 |
| PRT390 | 50 | 12.5 | 50 | 12.5 | 50 | 12.5 | 50 | 25 | 12.5 | 25 |
| PRT391 | 25 | 12.5 | 25 | 50 | 12.5 | 50 | 12.5 | 50 | 12.5 | 50 |
| PRT392 | 50 | 12.5 | 50 | 12.5 | 50 | 12.5 | 50 | 12.5 | 50 | 12.5 |
| PRT393 | 12.5 | 50 | 25 | 12.5 | 25 | 50 | 12.5 | 50 | 12.5 | 12.5 |
| PRT394 | 12.5 | 50 | 12.5 | 50 | 12.5 | 50 | 12.5 | 50 | 25 | 12.5 |
| PRT395 | 50 | 12.5 | 50 | 12.5 | 50 | 12.5 | 50 | 12.5 | 50 | 12.5 |
| PRT396 | 12.5 | 25 | 50 | 25 | 12.5 | 50 | 12.5 | 50 | 12.5 | 50 |
| PRT397 | 50 | 12.5 | 50 | 25 | 12.5 | 25 | 50 | 12.5 | 50 | 12.5 |
| PRT398 | 12.5 | 50 | 12.5 | 50 | 12.5 | 50 | 12.5 | 12.5 | 12.5 | 100 |
| PRT399 | 50 | 12.5 | 50 | 12.5 | 50 | 12.5 | 50 | 12.5 | 50 | 12.5 |
| PRT400 | 12.5 | 50 | 12.5 | 50 | 12.5 | 25 | 50 | 25 | 12.5 | 25 |
| PRT401 | 12.5 | 50 | 12.5 | 50 | 12.5 | 50 | 12.5 | 50 | 12.5 | 12.5 |
| PRT402 | 12.5 | 50 | 12.5 | 50 | 12.5 | 50 | 12.5 | 25 | 50 | 25 |
| PRT403 | 25 | 50 | 25 | 12.5 | 25 | 50 | 25 | 12.5 | 25 | 50 |
| PRT404 | 12.5 | 25 | 50 | 12.5 | 50 | 12.5 | 50 | 12.5 | 50 | 12.5 |
| PRT405 | 12.5 | 12.5 | 12.5 | 12.5 | 12.5 | 12.5 | 12.5 | 12.5 | 50 | 12.5 |
| PRT406 | 12.5 | 50 | 25 | 12.5 | 25 | 12.5 | 25 | 12.5 | 25 | 12.5 |
| PRT407 | 12.5 | 25 | 12.5 | 25 | 12.5 | 25 | 12.5 | 12.5 | 12.5 | 12.5 |
| PRT408 | 50 | 12.5 | 50 | 12.5 | 50 | 100 | 50 | 25 | 12.5 | 25 |
| PRT409 | 25 | 12.5 | 25 | 50 | 12.5 | 50 | 12.5 | 50 | 12.5 | 50 |
| PRT410 | 50 | 12.5 | 50 | 12.5 | 12.5 | 12.5 | 50 | 12.5 | 25 | 50 |
| PRT411 | 12.5 | 25 | 50 | 25 | 12.5 | 50 | 12.5 | 50 | 12.5 | 50 |
| PRT412 | 50 | 12.5 | 25 | 50 | 25 | 12.5 | 25 | 12.5 | 25 | 12.5 |
| PRT413 | 12.5 | 12.5 | 50 | 12.5 | 50 | 12.5 | 50 | 12.5 | 12.5 | 12.5 |
| PRT414 | 12.5 | 12.5 | 12.5 | 12.5 | 25 | 12.5 | 25 | 12.5 | 25 | 50 |
| PRT415 | 12.5 | 25 | 50 | 25 | 12.5 | 25 | 50 | 25 | 12.5 | 25 |
| PRT416 | 25 | 12.5 | 25 | 50 | 25 | 12.5 | 25 | 50 | 25 | 12.5 |
| PRT417 | 50 | 25 | 12.5 | 25 | 12.5 | 25 | 12.5 | 12.5 | 12.5 | 12.5 |
| PRT418 | 12.5 | 12.5 | 50 | 12.5 | 25 | 50 | 25 | 12.5 | 25 | 50 |
| PRT419 | 12.5 | 25 | 50 | 25 | 12.5 | 25 | 50 | 25 | 12.5 | 25 |
| PRT420 | 25 | 12.5 | 25 | 50 | 12.5 | 50 | 12.5 | 50 | 100 | 50 |
| PRT421 | 50 | 12.5 | 50 | 12.5 | 50 | 12.5 | 50 | 25 | 12.5 | 25 |
| PRT422 | 25 | 12.5 | 25 | 12.5 | 25 | 12.5 | 12.5 | 25 | 12.5 | 25 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT423 | 25 | 12.5 | 25 | 50 | 25 | 12.5 | 25 | 50 | 25 | 12.5 |
| PRT424 | 50 | 25 | 12.5 | 25 | 50 | 25 | 12.5 | 25 | 50 | 25 |
| PRT425 | 25 | 50 | 25 | 12.5 | 25 | 50 | 12.5 | 50 | 12.5 | 50 |
| PRT426 | 50 | 50 | 50 | 50 | 12.5 | 12.5 | 12.5 | 12.5 | 25 | 50 |
| PRT427 | 12.5 | 25 | 50 | 25 | 12.5 | 25 | 50 | 25 | 12.5 | 25 |
| PRT428 | 25 | 12.5 | 25 | 50 | 25 | 12.5 | 50 | 12.5 | 50 | 12.5 |
| PRT429 | 12.5 | 50 | 12.5 | 50 | 12.5 | 50 | 12.5 | 25 | 50 | 25 |
| PRT430 | 25 | 50 | 25 | 12.5 | 25 | 50 | 25 | 12.5 | 50 | 12.5 |
| PRT431 | 12.5 | 50 | 12.5 | 50 | 12.5 | 50 | 12.5 | 50 | 25 | 12.5 |
| PRT432 | 50 | 25 | 12.5 | 25 | 50 | 25 | 12.5 | 25 | 50 | 25 |
| PRT433 | 25 | 12.5 | 12.5 | 50 | 12.5 | 50 | 12.5 | 50 | 12.5 | 50 |
| PRT434 | 50 | 12.5 | 50 | 12.5 | 50 | 12.5 | 50 | 25 | 12.5 | 25 |
| PRT435 | 25 | 12.5 | 25 | 12.5 | 25 | 12.5 | 25 | 12.5 | 25 | 50 |
| PRT436 | 25 | 50 | 25 | 12.5 | 50 | 12.5 | 50 | 12.5 | 50 | 100 |
| PRT437 | 12.5 | 50 | 25 | 12.5 | 25 | 50 | 25 | 12.5 | 25 | 50 |
| PRT438 | 12.5 | 50 | 12.5 | 50 | 12.5 | 50 | 12.5 | 50 | 12.5 | 50 |
| PRT439 | 12.5 | 25 | 50 | 25 | 12.5 | 25 | 50 | 12.5 | 50 | 12.5 |
| PRT440 | 12.5 | 50 | 12.5 | 50 | 12.5 | 50 | 12.5 | 25 | 50 | 25 |
| PRT441 | 25 | 50 | 25 | 12.5 | 25 | 50 | 12.5 | 50 | 12.5 | 50 |
| PRT442 | 50 | 25 | 12.5 | 25 | 50 | 25 | 12.5 | 12.5 | 12.5 | 25 |
| PRT443 | 25 | 12.5 | 12.5 | 12.5 | 12.5 | 25 | 12.5 | 25 | 12.5 | 50 |
| PRT444 | 12.5 | 25 | 50 | 12.5 | 50 | 12.5 | 50 | 12.5 | 50 | 12.5 |
| PRT445 | 12.5 | 50 | 25 | 12.5 | 25 | 50 | 12.5 | 12.5 | 12.5 | 12.5 |
| PRT446 | 12.5 | 12.5 | 50 | 12.5 | 50 | 12.5 | 50 | 25 | 12.5 | 25 |
| PRT447 | 25 | 12.5 | 25 | 50 | 25 | 12.5 | 25 | 50 | 12.5 | 50 |
| PRT448 | 50 | 100 | 50 | 12.5 | 50 | 25 | 12.5 | 25 | 50 | 12.5 |
| PRT449 | 12.5 | 50 | 12.5 | 50 | 25 | 12.5 | 25 | 50 | 12.5 | 50 |
| PRT450 | 12.5 | 12.5 | 50 | 12.5 | 50 | 12.5 | 50 | 12.5 | 50 | 12.5 |
| PRT451 | 50 | 25 | 12.5 | 25 | 50 | 12.5 | 50 | 12.5 | 50 | 12.5 |
| PRT452 | 12.5 | 12.5 | 12.5 | 50 | 12.5 | 50 | 25 | 12.5 | 25 | 50 |
| PRT453 | 12.5 | 25 | 50 | 25 | 12.5 | 25 | 50 | 25 | 12.5 | 25 |
| PRT454 | 12.5 | 25 | 50 | 25 | 12.5 | 25 | 50 | 12.5 | 50 | 12.5 |
| PRT455 | 12.5 | 50 | 12.5 | 50 | 12.5 | 50 | 12.5 | 50 | 100 | 50 |
| PRT456 | 12.5 | 50 | 12.5 | 12.5 | 12.5 | 50 | 12.5 | 50 | 12.5 | 25 |
| PRT457 | 25 | 12.5 | 50 | 25 | 12.5 | 25 | 50 | 12.5 | 50 | 12.5 |
| PRT458 | 12.5 | 12.5 | 12.5 | 12.5 | 25 | 12.5 | 25 | 12.5 | 25 | 12.5 |
| PRT459 | 12.5 | 25 | 50 | 25 | 12.5 | 25 | 50 | 25 | 12.5 | 25 |
| PRT460 | 25 | 12.5 | 25 | 50 | 12.5 | 50 | 25 | 12.5 | 50 | 12.5 |
| PRT461 | 12.5 | 50 | 12.5 | 50 | 12.5 | 50 | 25 | 12.5 | 25 | 12.5 |
| PRT462 | 12.5 | 100 | 12.5 | 12.5 | 12.5 | 12.5 | 50 | 25 | 12.5 | 25 |
| PRT463 | 12.5 | 50 | 12.5 | 50 | 12.5 | 50 | 12.5 | 12.5 | 12.5 | 50 |
| PRT464 | 50 | 12.5 | 50 | 12.5 | 25 | 50 | 25 | 12.5 | 50 | 12.5 |
| PRT465 | 12.5 | 50 | 12.5 | 50 | 12.5 | 50 | 12.5 | 50 | 12.5 | 50 |
| PRT466 | 50 | 12.5 | 50 | 12.5 | 50 | 12.5 | 50 | 12.5 | 50 | 12.5 |
| PRT467 | 12.5 | 12.5 | 25 | 12.5 | 25 | 50 | 25 | 12.5 | 25 | 50 |
| PRT468 | 12.5 | 25 | 50 | 25 | 12.5 | 50 | 12.5 | 50 | 12.5 | 50 |
| PRT469 | 25 | 12.5 | 25 | 50 | 25 | 12.5 | 50 | 12.5 | 50 | 12.5 |
| PRT470 | 12.5 | 50 | 12.5 | 50 | 25 | 12.5 | 25 | 50 | 12.5 | 50 |
| PRT471 | 12.5 | 12.5 | 12.5 | 12.5 | 12.5 | 12.5 | 12.5 | 12.5 | 25 | 12.5 |
| PRT472 | 12.5 | 25 | 50 | 25 | 12.5 | 25 | 50 | 12.5 | 50 | 12.5 |
| PRT473 | 12.5 | 25 | 50 | 12.5 | 50 | 25 | 12.5 | 25 | 50 | 25 |
| PRT474 | 25 | 25 | 25 | 25 | 50 | 12.5 | 50 | 12.5 | 50 | 12.5 |
| PRT475 | 12.5 | 50 | 25 | 25 | 25 | 25 | 12.5 | 50 | 12.5 | 50 |
| PRT476 | 12.5 | 50 | 12.5 | 50 | 12.5 | 50 | 25 | 25 | 12.5 | 50 |
| PRT477 | 50 | 12.5 | 50 | 25 | 12.5 | 25 | 50 | 25 | 12.5 | 25 |
| PRT478 | 25 | 12.5 | 25 | 50 | 25 | 100 | 25 | 50 | 25 | 12.5 |
| PRT479 | 50 | 25 | 12.5 | 25 | 50 | 25 | 12.5 | 25 | 50 | 25 |
| PRT480 | 25 | 50 | 25 | 12.5 | 25 | 50 | 25 | 12.5 | 25 | 50 |
| PRT481 | 12.5 | 25 | 50 | 12.5 | 50 | 12.5 | 50 | 12.5 | 50 | 12.5 |
| PRT482 | 12.5 | 50 | 12.5 | 25 | 50 | 25 | 12.5 | 25 | 50 | 25 |
| PRT483 | 25 | 50 | 25 | 12.5 | 25 | 50 | 25 | 12.5 | 25 | 50 |
| PRT484 | 12.5 | 25 | 50 | 12.5 | 50 | 12.5 | 50 | 12.5 | 50 | 12.5 |
| PRT485 | 12.5 | 50 | 25 | 12.5 | 25 | 50 | 25 | 12.5 | 25 | 50 |
| PRT486 | 50 | 12.5 | 50 | 12.5 | 50 | 12.5 | 50 | 12.5 | 50 | 25 |
| PRT487 | 25 | 12.5 | 25 | 12.5 | 25 | 12.5 | 25 | 12.5 | 50 | 12.5 |
| PRT488 | 12.5 | 50 | 12.5 | 50 | 12.5 | 50 | 12.5 | 50 | 12.5 | 50 |
| PRT489 | 12.5 | 12.5 | 25 | 12.5 | 25 | 12.5 | 25 | 50 | 25 | 12.5 |
| PRT490 | 50 | 25 | 12.5 | 25 | 50 | 25 | 12.5 | 25 | 50 | 25 |
| PRT491 | 25 | 50 | 12.5 | 50 | 100 | 50 | 12.5 | 50 | 25 | 12.5 |
| PRT492 | 50 | 25 | 12.5 | 25 | 50 | 25 | 12.5 | 50 | 12.5 | 50 |
| PRT493 | 50 | 12.5 | 50 | 25 | 12.5 | 25 | 50 | 25 | 12.5 | 25 |
| PRT494 | 25 | 12.5 | 25 | 50 | 25 | 12.5 | 25 | 50 | 25 | 12.5 |
| PRT495 | 50 | 25 | 12.5 | 25 | 50 | 25 | 12.5 | 25 | 12.5 | 25 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT496 | 12.5 | 50 | 12.5 | 50 | 12.5 | 50 | 12.5 | 25 | 50 | 25 |
| PRT497 | 25 | 50 | 12.5 | 25 | 50 | 25 | 25 | 50 | 12.5 | 50 |
| PRT498 | 50 | 12.5 | 12.5 | 12.5 | 12.5 | 25 | 12.5 | 25 | 12.5 | 25 |
| PRT499 | 25 | 100 | 25 | 12.5 | 25 | 12.5 | 25 | 50 | 25 | 12.5 |
| PRT500 | 50 | 25 | 12.5 | 25 | 50 | 25 | 12.5 | 25 | 50 | 25 |
| PRT501 | 25 | 50 | 25 | 12.5 | 25 | 12.5 | 25 | 12.5 | 25 | 12.5 |
| PRT502 | 12.5 | 12.5 | 12.5 | 12.5 | 12.5 | 12.5 | 12.5 | 12.5 | 50 | 25 |
| PRT503 | 25 | 50 | 25 | 12.5 | 25 | 50 | 12.5 | 50 | 12.5 | 50 |
| PRT504 | 50 | 12.5 | 50 | 12.5 | 25 | 50 | 25 | 12.5 | 50 | 12.5 |
| PRT505 | 12.5 | 50 | 12.5 | 50 | 12.5 | 50 | 25 | 12.5 | 25 | 50 |
| PRT506 | 12.5 | 25 | 50 | 25 | 12.5 | 25 | 50 | 25 | 12.5 | 12.5 |
| PRT507 | 50 | 12.5 | 50 | 12.5 | 50 | 12.5 | 50 | 12.5 | 50 | 25 |
| PRT508 | 25 | 50 | 25 | 12.5 | 50 | 100 | 50 | 12.5 | 12.5 | 25 |
| PRT509 | 25 | 12.5 | 25 | 12.5 | 12.5 | 12.5 | 12.5 | 12.5 | 12.5 | 25 |
| PRT510 | 25 | 12.5 | 25 | 50 | 25 | 12.5 | 25 | 50 | 25 | 12.5 |
| PRT511 | 12.5 | 50 | 12.5 | 50 | 12.5 | 25 | 50 | 25 | 12.5 | 25 |
| PRT512 | 25 | 12.5 | 25 | 50 | 25 | 12.5 | 25 | 50 | 25 | 12.5 |
| PRT513 | 12.5 | 50 | 12.5 | 25 | 50 | 25 | 12.5 | 50 | 12.5 | 12.5 |
| PRT514 | 12.5 | 50 | 25 | 12.5 | 25 | 12.5 | 25 | 12.5 | 25 | 12.5 |
| PRT515 | 12.5 | 25 | 12.5 | 25 | 50 | 25 | 100 | 50 | 12.5 | 50 |
| PRT516 | 50 | 12.5 | 50 | 12.5 | 25 | 50 | 25 | 12.5 | 25 | 50 |
| PRT517 | 12.5 | 25 | 50 | 25 | 12.5 | 25 | 50 | 25 | 12.5 | 25 |
| PRT518 | 25 | 12.5 | 25 | 50 | 25 | 12.5 | 25 | 12.5 | 25 | 12.5 |
| PRT519 | 12.5 | 12.5 | 25 | 12.5 | 25 | 12.5 | 25 | 12.5 | 25 | 12.5 |
| PRT520 | 12.5 | 25 | 12.5 | 25 | 12.5 | 25 | 50 | 25 | 12.5 | 25 |
| PRT521 | 25 | 12.5 | 25 | 50 | 25 | 12.5 | 25 | 50 | 25 | 12.5 |
| PRT522 | 50 | 25 | 12.5 | 25 | 50 | 25 | 12.5 | 25 | 50 | 25 |
| PRT523 | 25 | 50 | 25 | 12.5 | 25 | 50 | 12.5 | 50 | 12.5 | 12.5 |
| PRT524 | 12.5 | 12.5 | 25 | 12.5 | 25 | 100 | 25 | 12.5 | 25 | 50 |
| PRT525 | 12.5 | 25 | 50 | 25 | 12.5 | 25 | 50 | 25 | 12.5 | 25 |
| PRT526 | 25 | 12.5 | 25 | 50 | 25 | 12.5 | 50 | 12.5 | 50 | 12.5 |
| PRT527 | 12.5 | 50 | 12.5 | 25 | 50 | 25 | 12.5 | 25 | 50 | 25 |
| PRT528 | 25 | 50 | 25 | 12.5 | 25 | 50 | 25 | 12.5 | 25 | 50 |
| PRT529 | 12.5 | 25 | 50 | 25 | 12.5 | 25 | 50 | 25 | 12.5 | 25 |
| PRT530 | 12.5 | 25 | 50 | 25 | 12.5 | 25 | 50 | 25 | 12.5 | 25 |
| PRT531 | 25 | 12.5 | 25 | 50 | 12.5 | 50 | 12.5 | 50 | 12.5 | 50 |
| PRT532 | 50 | 12.5 | 12.5 | 12.5 | 12.5 | 12.5 | 50 | 12.5 | 50 | 12.5 |
| PRT533 | 25 | 100 | 25 | 50 | 25 | 12.5 | 25 | 50 | 25 | 12.5 |
| PRT534 | 12.5 | 50 | 12.5 | 50 | 12.5 | 50 | 12.5 | 25 | 50 | 25 |
| PRT535 | 25 | 50 | 12.5 | 50 | 12.5 | 50 | 12.5 | 50 | 12.5 | 50 |
| PRT536 | 50 | 12.5 | 50 | 12.5 | 50 | 12.5 | 50 | 12.5 | 50 | 12.5 |
| PRT537 | 25 | 12.5 | 25 | 50 | 25 | 12.5 | 25 | 12.5 | 25 | 12.5 |
| PRT538 | 12.5 | 25 | 12.5 | 25 | 12.5 | 25 | 12.5 | 12.5 | 12.5 | 50 |
| PRT539 | 50 | 12.5 | 25 | 50 | 25 | 12.5 | 25 | 50 | 12.5 | 50 |
| PRT540 | 50 | 12.5 | 12.5 | 50 | 12.5 | 25 | 50 | 25 | 12.5 | 50 |
| PRT541 | 50 | 100 | 50 | 12.5 | 50 | 12.5 | 50 | 12.5 | 25 | 50 |
| PRT542 | 12.5 | 25 | 50 | 25 | 12.5 | 50 | 12.5 | 50 | 12.5 | 50 |
| PRT543 | 50 | 12.5 | 50 | 12.5 | 50 | 25 | 12.5 | 25 | 50 | 25 |
| PRT544 | 25 | 12.5 | 25 | 12.5 | 12.5 | 12.5 | 12.5 | 12.5 | 12.5 | 12.5 |
| PRT545 | 12.5 | 12.5 | 25 | 12.5 | 25 | 12.5 | 12.5 | 12.5 | 12.5 | 50 |
| PRT546 | 50 | 12.5 | 50 | 12.5 | 50 | 12.5 | 50 | 12.5 | 25 | 50 |
| PRT547 | 12.5 | 25 | 50 | 25 | 12.5 | 25 | 50 | 25 | 12.5 | 25 |
| PRT548 | 25 | 50 | 25 | 12.5 | 25 | 50 | 25 | 12.5 | 25 | 50 |
| PRT549 | 50 | 12.5 | 50 | 12.5 | 50 | 12.5 | 25 | 12.5 | 25 | 12.5 |
| PRT550 | 12.5 | 25 | 12.5 | 25 | 12.5 | 25 | 12.5 | 25 | 12.5 | 25 |
| PRT551 | 25 | 50 | 25 | 12.5 | 25 | 50 | 25 | 12.5 | 25 | 50 |
| PRT552 | 100 | 50 | 12.5 | 50 | 12.5 | 50 | 25 | 12.5 | 25 | 12.5 |
| PRT553 | 50 | 25 | 12.5 | 25 | 50 | 25 | 12.5 | 25 | 50 | 25 |
| PRT554 | 50 | 12.5 | 50 | 25 | 12.5 | 25 | 50 | 25 | 12.5 | 25 |
| PRT555 | 25 | 12.5 | 25 | 50 | 25 | 12.5 | 25 | 50 | 25 | 12.5 |
| PRT556 | 50 | 12.5 | 50 | 12.5 | 50 | 25 | 25 | 25 | 12.5 | 25 |
| PRT557 | 25 | 12.5 | 25 | 12.5 | 25 | 12.5 | 25 | 12.5 | 25 | 12.5 |
| PRT558 | 25 | 12.5 | 25 | 50 | 25 | 12.5 | 25 | 50 | 25 | 12.5 |
| PRT559 | 50 | 25 | 12.5 | 25 | 50 | 25 | 12.5 | 25 | 50 | 25 |
| PRT560 | 25 | 50 | 25 | 50 | 25 | 50 | 25 | 50 | 50 | 50 |
| PRT561 | 50 | 25 | 50 | 25 | 50 | 25 | 50 | 25 | 50 | 25 |
| PRT562 | 25 | 50 | 25 | 50 | 25 | 50 | 25 | 12.5 | 25 | 50 |
| PRT563 | 12.5 | 25 | 50 | 25 | 12.5 | 25 | 50 | 25 | 12.5 | 25 |
| PRT564 | 12.5 | 50 | 12.5 | 25 | 50 | 25 | 12.5 | 50 | 12.5 | 50 |
| PRT565 | 12.5 | 50 | 50 | 100 | 50 | 12.5 | 50 | 12.5 | 50 | 12.5 |
| PRT566 | 12.5 | 50 | 12.5 | 50 | 12.5 | 25 | 50 | 25 | 12.5 | 25 |
| PRT567 | 25 | 12.5 | 25 | 50 | 25 | 12.5 | 50 | 12.5 | 12.5 | 12.5 |
| PRT568 | 12.5 | 12.5 | 50 | 12.5 | 25 | 50 | 25 | 12.5 | 25 | 50 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT569 | 12.5 | 25 | 12.5 | 12.5 | 25 | 100 | 25 | 12.5 | 25 | 12.5 |
| PRT570 | 12.5 | 25 | 50 | 25 | 12.5 | 25 | 50 | 25 | 12.5 | 50 |
| PRT571 | 50 | 12.5 | 50 | 12.5 | 50 | 12.5 | 50 | 25 | 12.5 | 50 |
| PRT572 | 50 | 12.5 | 50 | 12.5 | 50 | 12.5 | 50 | 12.5 | 25 | 12.5 |
| PRT573 | 12.5 | 25 | 12.5 | 25 | 12.5 | 12.5 | 50 | 12.5 | 50 | 12.5 |
| PRT574 | 12.5 | 50 | 12.5 | 50 | 25 | 12.5 | 25 | 50 | 25 | 12.5 |
| PRT575 | 12.5 | 50 | 12.5 | 50 | 12.5 | 50 | 12.5 | 50 | 12.5 | 12.5 |
| PRT576 | 12.5 | 12.5 | 12.5 | 12.5 | 12.5 | 12.5 | 50 | 12.5 | 50 | 25 |
| PRT577 | 25 | 50 | 25 | 12.5 | 25 | 50 | 12.5 | 50 | 12.5 | 50 |
| PRT578 | 50 | 12.5 | 50 | 12.5 | 50 | 12.5 | 50 | 12.5 | 50 | 12.5 |
| PRT579 | 12.5 | 12.5 | 12.5 | 25 | 12.5 | 25 | 12.5 | 25 | 100 | 25 |
| PRT580 | 25 | 12.5 | 25 | 12.5 | 25 | 12.5 | 50 | 12.5 | 50 | 12.5 |
| PRT581 | 12.5 | 50 | 12.5 | 12.5 | 50 | 25 | 12.5 | 25 | 50 | 25 |
| PRT582 | 50 | 12.5 | 50 | 12.5 | 12.5 | 12.5 | 25 | 50 | 25 | 12.5 |
| PRT583 | 50 | 12.5 | 50 | 12.5 | 12.5 | 12.5 | 50 | 50 | 50 | 50 |
| PRT584 | 50 | 25 | 50 | 25 | 50 | 25 | 50 | 25 | 50 | 25 |
| PRT585 | 50 | 50 | 50 | 50 | 50 | 50 | 12.5 | 50 | 12.5 | 50 |
| PRT586 | 50 | 12.5 | 50 | 12.5 | 50 | 12.5 | 25 | 50 | 25 | 12.5 |
| PRT587 | 50 | 25 | 12.5 | 25 | 50 | 25 | 12.5 | 25 | 50 | 25 |
| PRT588 | 25 | 50 | 25 | 12.5 | 25 | 12.5 | 25 | 12.5 | 25 | 12.5 |
| PRT589 | 12.5 | 12.5 | 12.5 | 12.5 | 12.5 | 12.5 | 12.5 | 12.5 | 12.5 | 25 |
| PRT590 | 25 | 12.5 | 25 | 50 | 25 | 12.5 | 25 | 50 | 25 | 12.5 |
| PRT591 | 50 | 25 | 12.5 | 25 | 50 | 12.5 | 50 | 12.5 | 50 | 12.5 |
| PRT592 | 12.5 | 50 | 12.5 | 50 | 12.5 | 50 | 100 | 50 | 25 | 12.5 |
| PRT593 | 50 | 25 | 12.5 | 25 | 50 | 25 | 12.5 | 25 | 50 | 25 |
| PRT594 | 25 | 50 | 12.5 | 50 | 12.5 | 50 | 12.5 | 50 | 12.5 | 50 |
| PRT595 | 50 | 12.5 | 50 | 12.5 | 50 | 12.5 | 50 | 12.5 | 50 | 25 |
| PRT596 | 25 | 50 | 25 | 12.5 | 25 | 50 | 25 | 12.5 | 25 | 50 |
| PRT597 | 12.5 | 50 | 12.5 | 25 | 50 | 25 | 12.5 | 50 | 25 | 12.5 |
| PRT598 | 50 | 12.5 | 50 | 12.5 | 25 | 50 | 25 | 12.5 | 50 | 25 |
| PRT599 | 25 | 50 | 12.5 | 50 | 12.5 | 50 | 12.5 | 50 | 12.5 | 50 |
| PRT600 | 12.5 | 25 | 50 | 25 | 12.5 | 25 | 50 | 25 | 12.5 | 25 |
| PRT601 | 25 | 12.5 | 25 | 50 | 25 | 12.5 | 50 | 100 | 50 | 12.5 |
| PRT602 | 12.5 | 50 | 12.5 | 50 | 12.5 | 50 | 12.5 | 50 | 25 | 12.5 |
| PRT603 | 50 | 25 | 12.5 | 25 | 50 | 12.5 | 50 | 12.5 | 50 | 12.5 |
| PRT604 | 12.5 | 25 | 50 | 25 | 12.5 | 25 | 12.5 | 25 | 12.5 | 25 |
| PRT605 | 25 | 50 | 25 | 12.5 | 25 | 50 | 25 | 12.5 | 25 | 50 |
| PRT606 | 12.5 | 25 | 50 | 25 | 12.5 | 25 | 50 | 25 | 12.5 | 25 |
| PRT607 | 25 | 12.5 | 25 | 50 | 12.5 | 50 | 12.5 | 50 | 12.5 | 50 |
| PRT608 | 50 | 12.5 | 50 | 25 | 12.5 | 25 | 50 | 25 | 12.5 | 25 |
| PRT609 | 25 | 12.5 | 25 | 50 | 25 | 12.5 | 25 | 50 | 25 | 12.5 |
| PRT610 | 25 | 12.5 | 25 | 50 | 12.5 | 50 | 12.5 | 50 | 12.5 | 50 |
| PRT611 | 25 | 50 | 25 | 12.5 | 25 | 50 | 25 | 12.5 | 25 | 50 |
| PRT612 | 12.5 | 25 | 50 | 25 | 12.5 | 25 | 50 | 25 | 12.5 | 25 |
| PRT613 | 12.5 | 25 | 50 | 25 | 12.5 | 25 | 50 | 25 | 12.5 | 50 |
| PRT614 | 50 | 50 | 50 | 12.5 | 12.5 | 25 | 12.5 | 25 | 12.5 | 25 |
| PRT615 | 25 | 12.5 | 25 | 12.5 | 25 | 50 | 25 | 12.5 | 25 | 50 |
| PRT616 | 12.5 | 25 | 50 | 12.5 | 25 | 12.5 | 25 | 12.5 | 25 | 12.5 |
| PRT617 | 12.5 | 25 | 12.5 | 25 | 12.5 | 25 | 12.5 | 25 | 12.5 | 25 |
| PRT618 | 25 | 12.5 | 50 | 12.5 | 50 | 12.5 | 50 | 12.5 | 50 | 25 |
| PRT619 | 25 | 50 | 25 | 12.5 | 25 | 50 | 25 | 12.5 | 25 | 50 |
| PRT620 | 12.5 | 25 | 50 | 12.5 | 50 | 12.5 | 50 | 25 | 12.5 | 25 |
| PRT621 | 25 | 50 | 25 | 50 | 25 | 50 | 25 | 50 | 25 | 50 |
| PRT622 | 50 | 25 | 50 | 25 | 12.5 | 50 | 12.5 | 50 | 12.5 | 12.5 |
| PRT623 | 12.5 | 12.5 | 12.5 | 12.5 | 12.5 | 12.5 | 50 | 12.5 | 25 | 50 |
| PRT624 | 100 | 25 | 50 | 25 | 12.5 | 25 | 12.5 | 25 | 12.5 | 25 |
| PRT625 | 25 | 12.5 | 25 | 50 | 25 | 12.5 | 25 | 50 | 25 | 12.5 |
| PRT626 | 50 | 25 | 12.5 | 25 | 50 | 25 | 12.5 | 25 | 50 | 25 |
| PRT627 | 25 | 12.5 | 12.5 | 12.5 | 12.5 | 12.5 | 12.5 | 50 | 12.5 | 50 |
| PRT628 | 12.5 | 25 | 12.5 | 25 | 12.5 | 25 | 12.5 | 25 | 12.5 | 25 |
| PRT629 | 25 | 12.5 | 25 | 12.5 | 12.5 | 12.5 | 12.5 | 12.5 | 50 | 12.5 |
| PRT630 | 25 | 12.5 | 25 | 12.5 | 25 | 12.5 | 25 | 12.5 | 25 | 12.5 |
| PRT631 | 12.5 | 25 | 12.5 | 25 | 12.5 | 25 | 12.5 | 25 | 12.5 | 25 |
| PRT632 | 25 | 12.5 | 25 | 12.5 | 25 | 50 | 25 | 12.5 | 25 | 50 |
| PRT633 | 50 | 12.5 | 50 | 12.5 | 50 | 12.5 | 50 | 12.5 | 50 | 25 |
| PRT634 | 25 | 50 | 25 | 12.5 | 25 | 12.5 | 25 | 25 | 12.5 | 25 |
| PRT635 | 25 | 12.5 | 25 | 12.5 | 25 | 12.5 | 12.5 | 25 | 12.5 | 25 |
| PRT636 | 25 | 50 | 25 | 12.5 | 25 | 50 | 25 | 12.5 | 25 | 50 |
| PRT637 | 12.5 | 25 | 50 | 12.5 | 25 | 50 | 25 | 12.5 | 25 | 50 |
| PRT638 | 12.5 | 50 | 12.5 | 25 | 50 | 25 | 12.5 | 50 | 25 | 50 |
| PRT639 | 50 | 12.5 | 50 | 12.5 | 50 | 25 | 12.5 | 25 | 50 | 25 |
| PRT640 | 25 | 50 | 12.5 | 25 | 50 | 12.5 | 25 | 50 | 12.5 | 25 |
| PRT641 | 25 | 12.5 | 25 | 50 | 25 | 12.5 | 25 | 50 | 12.5 | 50 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT642 | 50 | 25 | 12.5 | 25 | 50 | 25 | 12.5 | 25 | 50 | 25 |
| PRT643 | 25 | 50 | 25 | 12.5 | 25 | 50 | 25 | 12.5 | 25 | 50 |
| PRT644 | 12.5 | 25 | 50 | 25 | 12.5 | 25 | 50 | 25 | 100 | 25 |
| PRT645 | 25 | 12.5 | 25 | 50 | 25 | 12.5 | 50 | 12.5 | 50 | 12.5 |
| PRT646 | 12.5 | 12.5 | 12.5 | 12.5 | 25 | 50 | 25 | 12.5 | 25 | 50 |
| PRT647 | 12.5 | 25 | 50 | 12.5 | 50 | 12.5 | 50 | 12.5 | 50 | 25 |
| PRT648 | 25 | 50 | 25 | 12.5 | 50 | 12.5 | 50 | 12.5 | 50 | 12.5 |
| PRT649 | 12.5 | 50 | 12.5 | 50 | 12.5 | 50 | 12.5 | 25 | 50 | 25 |
| PRT650 | 25 | 50 | 12.5 | 50 | 25 | 12.5 | 25 | 50 | 12.5 | 50 |
| PRT651 | 50 | 25 | 12.5 | 25 | 50 | 25 | 12.5 | 25 | 50 | 25 |
| PRT652 | 25 | 50 | 25 | 12.5 | 25 | 50 | 25 | 12.5 | 25 | 50 |
| PRT653 | 12.5 | 25 | 50 | 25 | 12.5 | 50 | 25 | 12.5 | 50 | 25 |
| PRT654 | 50 | 12.5 | 50 | 12.5 | 50 | 12.5 | 50 | 25 | 12.5 | 25 |
| PRT655 | 50 | 12.5 | 25 | 50 | 25 | 12.5 | 50 | 25 | 12.5 | 25 |
| PRT656 | 12.5 | 50 | 12.5 | 50 | 12.5 | 12.5 | 12.5 | 25 | 12.5 | 12.5 |
| PRT657 | 12.5 | 12.5 | 12.5 | 25 | 12.5 | 25 | 12.5 | 12.5 | 25 | 12.5 |
| PRT658 | 25 | 50 | 25 | 12.5 | 25 | 50 | 12.5 | 25 | 50 | 12.5 |
| PRT659 | 50 | 25 | 12.5 | 25 | 50 | 25 | 25 | 12.5 | 25 | 50 |
| PRT660 | 50 | 12.5 | 12.5 | 50 | 12.5 | 50 | 12.5 | 25 | 50 | 12.5 |
| PRT661 | 25 | 12.5 | 25 | 50 | 25 | 12.5 | 25 | 50 | 25 | 25 |
| PRT662 | 12.5 | 25 | 50 | 25 | 12.5 | 25 | 25 | 50 | 12.5 | 50 |
| PRT663 | 25 | 50 | 25 | 12.5 | 25 | 50 | 12.5 | 25 | 50 | 12.5 |
| PRT664 | 50 | 25 | 12.5 | 25 | 50 | 12.5 | 25 | 50 | 12.5 | 25 |
| PRT665 | 50 | 25 | 12.5 | 25 | 50 | 25 | 12.5 | 25 | 50 | 25 |
| PRT666 | 25 | 50 | 25 | 12.5 | 25 | 50 | 25 | 12.5 | 25 | 25 |
| PRT667 | 25 | 12.5 | 50 | 12.5 | 50 | 12.5 | 50 | 25 | 12.5 | 50 |
| PRT668 | 50 | 12.5 | 50 | 12.5 | 50 | 100 | 25 | 25 | 50 | 100 |
| PRT669 | 50 | 25 | 12.5 | 25 | 12.5 | 25 | 12.5 | 25 | 12.5 | 12.5 |
| PRT670 | 12.5 | 25 | 12.5 | 12.5 | 12.5 | 25 | 12.5 | 25 | 12.5 | 25 |
| PRT671 | 12.5 | 12.5 | 12.5 | 12.5 | 25 | 12.5 | 25 | 12.5 | 25 | 12.5 |
| PRT672 | 25 | 12.5 | 25 | 12.5 | 12.5 | 25 | 12.5 | 25 | 50 | 12.5 |
| PRT673 | 12.5 | 50 | 50 | 25 | 50 | 25 | 25 | 50 | 12.5 | 50 |
| PRT674 | 25 | 50 | 25 | 12.5 | 50 | 25 | 25 | 12.5 | 50 | 25 |
| PRT675 | 50 | 25 | 12.5 | 50 | 25 | 12.5 | 50 | 25 | 12.5 | 25 |
| PRT676 | 50 | 12.5 | 50 | 25 | 12.5 | 50 | 25 | 12.5 | 50 | 12.5 |
| PRT677 | 25 | 12.5 | 50 | 25 | 12.5 | 25 | 25 | 50 | 12.5 | 50 |
| PRT678 | 12.5 | 50 | 12.5 | 50 | 25 | 12.5 | 50 | 25 | 12.5 | 50 |
| PRT679 | 50 | 25 | 25 | 12.5 | 25 | 50 | 12.5 | 25 | 50 | 25 |
| PRT680 | 25 | 25 | 50 | 25 | 12.5 | 25 | 50 | 12.5 | 50 | 25 |
| PRT681 | 50 | 25 | 12.5 | 25 | 50 | 12.5 | 25 | 50 | 12.5 | 50 |
| PRT682 | 12.5 | 50 | 25 | 25 | 12.5 | 25 | 25 | 50 | 12.5 | 50 |
| PRT683 | 25 | 50 | 25 | 12.5 | 50 | 25 | 25 | 12.5 | 50 | 25 |
| PRT684 | 25 | 50 | 25 | 12.5 | 50 | 25 | 12.5 | 25 | 50 | 12.5 |
| PRT685 | 25 | 12.5 | 50 | 12.5 | 50 | 12.5 | 50 | 25 | 50 | 50 |
| PRT686 | 50 | 25 | 50 | 50 | 50 | 50 | 50 | 50 | 25 | 50 |
| PRT687 | 25 | 50 | 12.5 | 25 | 25 | 50 | 25 | 12.5 | 25 | 50 |
| PRT688 | 12.5 | 25 | 50 | 12.5 | 25 | 50 | 12.5 | 50 | 100 | 50 |
| PRT689 | 25 | 50 | 12.5 | 25 | 50 | 12.5 | 50 | 25 | 12.5 | 25 |
| PRT690 | 50 | 25 | 25 | 12.5 | 25 | 25 | 50 | 12.5 | 50 | 12.5 |
| PRT691 | 50 | 12.5 | 50 | 25 | 12.5 | 50 | 12.5 | 25 | 50 | 12.5 |
| PRT692 | 25 | 12.5 | 50 | 25 | 12.5 | 50 | 25 | 12.5 | 25 | 50 |
| PRT693 | 12.5 | 50 | 25 | 12.5 | 25 | 50 | 12.5 | 25 | 50 | 50 |
| PRT694 | 25 | 50 | 25 | 50 | 25 | 12.5 | 25 | 50 | 12.5 | 50 |
| PRT695 | 12.5 | 25 | 25 | 12.5 | 25 | 50 | 50 | 12.5 | 50 | 12.5 |
| PRT696 | 25 | 12.5 | 50 | 25 | 12.5 | 25 | 25 | 50 | 25 | 12.5 |
| PRT697 | 25 | 50 | 12.5 | 50 | 25 | 12.5 | 50 | 12.5 | 25 | 25 |
| PRT698 | 25 | 12.5 | 50 | 25 | 12.5 | 25 | 50 | 25 | 25 | 12.5 |
| PRT699 | 25 | 12.5 | 25 | 50 | 12.5 | 50 | 25 | 12.5 | 25 | 50 |
| PRT700 | 50 | 25 | 12.5 | 25 | 50 | 12.5 | 25 | 50 | 25 | 12.5 |
| PRT701 | 25 | 12.5 | 50 | 25 | 12.5 | 50 | 12.5 | 25 | 50 | 12.5 |
| PRT702 | 50 | 12.5 | 50 | 25 | 25 | 12.5 | 25 | 25 | 50 | 12.5 |
| PRT703 | 50 | 12.5 | 25 | 50 | 25 | 12.5 | 50 | 25 | 12.5 | 50 |
| PRT704 | 25 | 50 | 25 | 50 | 50 | 25 | 12.5 | 50 | 25 | 12.5 |
| PRT705 | 50 | 12.5 | 50 | 12.5 | 25 | 100 | 25 | 50 | 12.5 | 50 |
| PRT706 | 50 | 12.5 | 12.5 | 25 | 50 | 12.5 | 50 | 12.5 | 50 | 12.5 |
| PRT707 | 25 | 50 | 12.5 | 12.5 | 25 | 12.5 | 12.5 | 12.5 | 25 | 12.5 |
| PRT708 | 25 | 50 | 25 | 50 | 12.5 | 50 | 12.5 | 50 | 12.5 | 50 |
| PRT709 | 12.5 | 25 | 50 | 12.5 | 50 | 12.5 | 50 | 25 | 12.5 | 50 |
| PRT710 | 12.5 | 50 | 12.5 | 50 | 12.5 | 50 | 25 | 12.5 | 25 | 50 |
| PRT711 | 12.5 | 50 | 12.5 | 25 | 50 | 12.5 | 50 | 12.5 | 25 | 50 |
| PRT712 | 12.5 | 50 | 25 | 50 | 25 | 12.5 | 25 | 50 | 25 | 12.5 |
| PRT713 | 25 | 12.5 | 12.5 | 50 | 12.5 | 50 | 12.5 | 50 | 12.5 | 50 |
| PRT714 | 25 | 12.5 | 12.5 | 12.5 | 50 | 12.5 | 50 | 12.5 | 50 | 12.5 |

TABLE 3-continued

MIC (µg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT715 | 50 | 25 | 12.5 | 50 | 12.5 | 50 | 12.5 | 25 | 50 | 12.5 |
| PRT716 | 50 | 25 | 12.5 | 25 | 50 | 25 | 12.5 | 25 | 50 | 12.5 |
| PRT717 | 12.5 | 50 | 12.5 | 50 | 12.5 | 25 | 50 | 25 | 12.5 | 50 |
| PRT718 | 25 | 50 | 25 | 25 | 25 | 25 | 12.5 | 25 | 50 | 12.5 |
| PRT719 | 12.5 | 50 | 12.5 | 50 | 12.5 | 50 | 50 | 50 | 50 | 50 |
| PRT720 | 25 | 12.5 | 12.5 | 50 | 12.5 | 25 | 50 | 25 | 12.5 | 50 |
| PRT721 | 12.5 | 25 | 50 | 25 | 12.5 | 25 | 50 | 12.5 | 12.5 | 50 |
| PRT722 | 25 | 50 | 12.5 | 50 | 25 | 12.5 | 25 | 50 | 25 | 12.5 |
| PRT723 | 50 | 100 | 100 | 50 | 12.5 | 25 | 12.5 | 25 | 25 | 12.5 |
| PRT724 | 12.5 | 12.5 | 12.5 | 25 | 12.5 | 25 | 12.5 | 25 | 12.5 | 25 |
| PRT725 | 12.5 | 25 | 50 | 12.5 | 25 | 50 | 25 | 12.5 | 50 | 25 |
| PRT726 | 50 | 25 | 25 | 12.5 | 25 | 50 | 25 | 12.5 | 50 | 25 |
| PRT727 | 25 | 50 | 12.5 | 50 | 25 | 12.5 | 25 | 50 | 12.5 | 50 |
| PRT728 | 25 | 25 | 12.5 | 25 | 12.5 | 25 | 12.5 | 12.5 | 12.5 | 25 |
| PRT729 | 25 | 12.5 | 25 | 12.5 | 25 | 12.5 | 25 | 12.5 | 25 | 50 |
| PRT730 | 12.5 | 25 | 25 | 50 | 25 | 12.5 | 25 | 50 | 12.5 | 25 |
| PRT731 | 12.5 | 50 | 12.5 | 25 | 50 | 25 | 12.5 | 25 | 25 | 50 |
| PRT732 | 50 | 12.5 | 50 | 25 | 12.5 | 25 | 50 | 25 | 25 | 12.5 |
| PRT733 | 12.5 | 50 | 12.5 | 50 | 12.5 | 25 | 50 | 25 | 12.5 | 25 |
| PRT734 | 12.5 | 25 | 50 | 12.5 | 50 | 25 | 12.5 | 25 | 25 | 50 |
| PRT735 | 50 | 12.5 | 25 | 12.5 | 25 | 50 | 25 | 12.5 | 50 | 25 |
| PRT736 | 25 | 50 | 50 | 50 | 25 | 12.5 | 25 | 12.5 | 25 | 50 |
| PRT737 | 50 | 12.5 | 50 | 25 | 12.5 | 25 | 50 | 25 | 12.5 | 25 |
| PRT738 | 12.5 | 25 | 50 | 12.5 | 50 | 12.5 | 25 | 50 | 25 | 25 |
| PRT739 | 50 | 12.5 | 50 | 12.5 | 25 | 50 | 25 | 12.5 | 50 | 25 |
| PRT740 | 12.5 | 50 | 12.5 | 50 | 12.5 | 12.5 | 50 | 25 | 12.5 | 25 |
| PRT741 | 50 | 12.5 | 25 | 50 | 12.5 | 50 | 12.5 | 50 | 25 | 12.5 |
| PRT742 | 12.5 | 50 | 25 | 12.5 | 50 | 12.5 | 25 | 12.5 | 50 | 25 |
| PRT743 | 50 | 12.5 | 12.5 | 12.5 | 50 | 12.5 | 50 | 100 | 25 | 50 |
| PRT744 | 50 | 12.5 | 50 | 12.5 | 50 | 12.5 | 50 | 25 | 25 | 12.5 |
| PRT745 | 25 | 50 | 12.5 | 50 | 12.5 | 50 | 12.5 | 25 | 50 | 25 |
| PRT746 | 50 | 12.5 | 50 | 12.5 | 50 | 12.5 | 25 | 25 | 25 | 12.5 |
| PRT747 | 50 | 12.5 | 12.5 | 12.5 | 12.5 | 50 | 12.5 | 50 | 25 | 12.5 |
| PRT748 | 25 | 12.5 | 25 | 50 | 12.5 | 50 | 12.5 | 50 | 12.5 | 25 |
| PRT749 | 12.5 | 50 | 12.5 | 25 | 50 | 12.5 | 50 | 12.5 | 50 | 25 |
| PRT750 | 12.5 | 50 | 25 | 12.5 | 25 | 50 | 12.5 | 50 | 12.5 | 50 |
| PRT751 | 25 | 50 | 12.5 | 50 | 25 | 12.5 | 25 | 50 | 25 | 12.5 |
| PRT752 | 25 | 12.5 | 12.5 | 12.5 | 50 | 12.5 | 25 | 50 | 25 | 12.5 |
| PRT753 | 50 | 12.5 | 50 | 12.5 | 50 | 12.5 | 50 | 12.5 | 25 | 50 |
| PRT754 | 12.5 | 50 | 25 | 12.5 | 25 | 50 | 25 | 12.5 | 50 | 25 |
| PRT755 | 50 | 12.5 | 50 | 12.5 | 50 | 12.5 | 50 | 12.5 | 12.5 | 25 |
| PRT756 | 25 | 12.5 | 50 | 12.5 | 50 | 12.5 | 50 | 12.5 | 50 | 12.5 |
| PRT757 | 12.5 | 50 | 12.5 | 25 | 50 | 12.5 | 50 | 12.5 | 25 | 50 |
| PRT758 | 25 | 50 | 50 | 25 | 50 | 25 | 12.5 | 25 | 12.5 | 12.5 |
| PRT759 | 12.5 | 25 | 12.5 | 12.5 | 12.5 | 12.5 | 25 | 12.5 | 12.5 | 25 |
| PRT760 | 25 | 12.5 | 50 | 12.5 | 50 | 12.5 | 50 | 12.5 | 50 | 12.5 |
| PRT761 | 12.5 | 50 | 12.5 | 50 | 25 | 12.5 | 25 | 50 | 12.5 | 25 |
| PRT762 | 12.5 | 50 | 12.5 | 50 | 12.5 | 50 | 12.5 | 50 | 25 | 12.5 |
| PRT763 | 50 | 12.5 | 25 | 12.5 | 25 | 12.5 | 12.5 | 12.5 | 50 | 25 |
| PRT764 | 25 | 50 | 100 | 50 | 12.5 | 50 | 12.5 | 25 | 25 | 50 |
| PRT765 | 50 | 12.5 | 50 | 12.5 | 12.5 | 12.5 | 12.5 | 12.5 | 12.5 | 12.5 |
| PRT766 | 50 | 25 | 12.5 | 50 | 25 | 12.5 | 25 | 50 | 25 | 12.5 |
| PRT767 | 50 | 25 | 12.5 | 50 | 12.5 | 25 | 50 | 25 | 12.5 | 50 |
| PRT768 | 50 | 25 | 12.5 | 50 | 12.5 | 50 | 25 | 12.5 | 25 | 12.5 |
| PRT769 | 12.5 | 12.5 | 25 | 12.5 | 25 | 12.5 | 12.5 | 12.5 | 25 | 12.5 |
| PRT770 | 12.5 | 50 | 12.5 | 50 | 25 | 12.5 | 25 | 50 | 12.5 | 50 |
| PRT771 | 12.5 | 50 | 12.5 | 50 | 12.5 | 50 | 12.5 | 50 | 12.5 | 50 |
| PRT772 | 50 | 12.5 | 50 | 12.5 | 50 | 12.5 | 25 | 50 | 25 | 12.5 |
| PRT773 | 25 | 12.5 | 50 | 12.5 | 50 | 12.5 | 50 | 12.5 | 50 | 12.5 |
| PRT774 | 12.5 | 12.5 | 25 | 12.5 | 25 | 12.5 | 12.5 | 12.5 | 12.5 | 50 |
| PRT775 | 25 | 50 | 12.5 | 50 | 12.5 | 50 | 12.5 | 50 | 12.5 | 50 |
| PRT776 | 50 | 12.5 | 25 | 50 | 12.5 | 12.5 | 12.5 | 12.5 | 25 | 12.5 |
| PRT777 | 12.5 | 50 | 12.5 | 12.5 | 50 | 50 | 12.5 | 50 | 25 | 12.5 |
| PRT778 | 12.5 | 50 | 12.5 | 50 | 12.5 | 12.5 | 12.5 | 12.5 | 25 | 12.5 |
| PRT779 | 12.5 | 50 | 12.5 | 50 | 12.5 | 50 | 12.5 | 50 | 12.5 | 50 |
| PRT780 | 50 | 12.5 | 50 | 12.5 | 50 | 25 | 12.5 | 25 | 50 | 12.5 |
| PRT781 | 50 | 12.5 | 50 | 25 | 12.5 | 25 | 50 | 12.5 | 50 | 12.5 |
| PRT782 | 25 | 12.5 | 12.5 | 12.5 | 12.5 | 12.5 | 12.5 | 25 | 12.5 | 50 |
| PRT783 | 12.5 | 50 | 12.5 | 25 | 50 | 25 | 25 | 25 | 50 | 12.5 |
| PRT784 | 25 | 12.5 | 50 | 12.5 | 50 | 12.5 | 50 | 12.5 | 50 | 12.5 |
| PRT785 | 50 | 25 | 25 | 12.5 | 50 | 12.5 | 25 | 50 | 25 | 50 |
| PRT786 | 25 | 12.5 | 50 | 12.5 | 12.5 | 25 | 12.5 | 25 | 12.5 | 12.5 |
| PRT787 | 12.5 | 12.5 | 12.5 | 12.5 | 12.5 | 25 | 50 | 25 | 25 | 12.5 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT788 | 100 | 50 | 25 | 12.5 | 25 | 50 | 25 | 12.5 | 50 | 50 |
| PRT789 | 50 | 25 | 12.5 | 50 | 12.5 | 25 | 25 | 50 | 25 | 12.5 |
| PRT790 | 50 | 25 | 25 | 12.5 | 25 | 50 | 25 | 12.5 | 50 | 12.5 |
| PRT791 | 12.5 | 50 | 12.5 | 50 | 12.5 | 25 | 50 | 25 | 12.5 | 12.5 |
| PRT792 | 50 | 12.5 | 12.5 | 25 | 50 | 25 | 12.5 | 50 | 12.5 | 50 |
| PRT793 | 12.5 | 50 | 12.5 | 25 | 50 | 25 | 12.5 | 25 | 50 | 12.5 |
| PRT794 | 12.5 | 50 | 12.5 | 25 | 50 | 25 | 12.5 | 25 | 50 | 12.5 |
| PRT795 | 25 | 50 | 50 | 12.5 | 25 | 50 | 25 | 25 | 25 | 50 |
| PRT796 | 50 | 12.5 | 50 | 50 | 50 | 5 | 50 | 12.5 | 50 | 50 |
| PRT797 | 12.5 | 50 | 25 | 50 | 12.5 | 50 | 12.5 | 12.5 | 12.5 | 12.5 |
| PRT798 | 25 | 12.5 | 50 | 12.5 | 50 | 12.5 | 50 | 12.5 | 50 | 25 |
| PRT799 | 12.5 | 12.5 | 12.5 | 5 | 12.5 | 12.5 | 12.5 | 12.5 | 50 | 25 |
| PRT800 | 50 | 25 | 12.5 | 50 | 12.5 | 50 | 12.5 | 12.5 | 50 | 25 |
| PRT801 | 12.5 | 50 | 25 | 12.5 | 25 | 12.5 | 12.5 | 12.5 | 12.5 | 12.5 |
| PRT802 | 12.5 | 25 | 12.5 | 12.5 | 12.5 | 25 | 12.5 | 25 | 25 | 12.5 |
| PRT803 | 50 | 12.5 | 25 | 50 | 25 | 25 | 100 | 50 | 12.5 | 50 |
| PRT804 | 50 | 12.5 | 50 | 12.5 | 12.5 | 12.5 | 50 | 12.5 | 25 | 50 |
| PRT805 | 50 | 12.5 | 12.5 | 12.5 | 12.5 | 12.5 | 50 | 12.5 | 50 | 12.5 |
| PRT806 | 25 | 12.5 | 12.5 | 12.5 | 12.5 | 12.5 | 25 | 12.5 | 25 | 25 |
| PRT807 | 50 | 25 | 12.5 | 50 | 12.5 | 25 | 50 | 12.5 | 50 | 12.5 |
| PRT808 | 50 | 12.5 | 50 | 25 | 12.5 | 25 | 50 | 25 | 12.5 | 50 |
| PRT809 | 12.5 | 25 | 25 | 50 | 12.5 | 25 | 50 | 25 | 12.5 | 25 |
| PRT810 | 50 | 25 | 12.5 | 50 | 25 | 50 | 25 | 50 | 50 | 25 |
| PRT811 | 25 | 12.5 | 12.5 | 12.5 | 12.5 | 12.5 | 12.5 | 25 | 25 | 25 |
| PRT812 | 12.5 | 12.5 | 25 | 50 | 25 | 12.5 | 50 | 12.5 | 50 | 12.5 |
| PRT813 | 50 | 50 | 50 | 25 | 50 | 25 | 25 | 25 | 50 | 12.5 |
| PRT814 | 25 | 50 | 12.5 | 12.5 | 25 | 12.5 | 25 | 12.5 | 12.5 | 12.5 |
| PRT815 | 12.5 | 12.5 | 12.5 | 25 | 12.5 | 25 | 50 | 25 | 12.5 | 25 |
| PRT816 | 50 | 100 | 50 | 25 | 12.5 | 25 | 50 | 25 | 25 | 12.5 |
| PRT817 | 12.5 | 50 | 25 | 12.5 | 25 | 50 | 25 | 12.5 | 50 | 12.5 |
| PRT818 | 50 | 25 | 12.5 | 12.5 | 25 | 25 | 25 | 25 | 12.5 | 12.5 |
| PRT819 | 25 | 12.5 | 12.5 | 25 | 12.5 | 25 | 50 | 12.5 | 50 | 25 |
| PRT820 | 50 | 12.5 | 50 | 12.5 | 50 | 12.5 | 50 | 12.5 | 12.5 | 25 |
| PRT821 | 12.5 | 12.5 | 25 | 25 | 50 | 25 | 12.5 | 50 | 12.5 | 50 |
| PRT822 | 25 | 50 | 12.5 | 50 | 12.5 | 12.5 | 12.5 | 25 | 12.5 | 12.5 |
| PRT823 | 12.5 | 25 | 12.5 | 25 | 12.5 | 25 | 50 | 25 | 12.5 | 50 |
| PRT824 | 25 | 50 | 25 | 12.5 | 25 | 50 | 25 | 12.5 | 50 | 25 |
| PRT825 | 12.5 | 25 | 50 | 25 | 12.5 | 25 | 50 | 12.5 | 50 | 25 |
| PRT826 | 50 | 25 | 100 | 50 | 12.5 | 12.5 | 25 | 12.5 | 12.5 | 12.5 |
| PRT827 | 25 | 12.5 | 12.5 | 50 | 25 | 12.5 | 25 | 50 | 12.5 | 50 |
| PRT828 | 50 | 12.5 | 50 | 12.5 | 50 | 12.5 | 50 | 25 | 12.5 | 25 |
| PRT829 | 25 | 12.5 | 25 | 50 | 25 | 12.5 | 25 | 50 | 12.5 | 12.5 |
| PRT830 | 12.5 | 12.5 | 12.5 | 25 | 12.5 | 25 | 12.5 | 25 | 12.5 | 12.5 |
| PRT831 | 25 | 12.5 | 25 | 12.5 | 25 | 50 | 12.5 | 50 | 25 | 12.5 |
| PRT832 | 12.5 | 12.5 | 12.5 | 25 | 12.5 | 25 | 12.5 | 12.5 | 25 | 12.5 |
| PRT833 | 25 | 12.5 | 12.5 | 50 | 12.5 | 50 | 12.5 | 25 | 50 | 12.5 |
| PRT834 | 25 | 12.5 | 25 | 50 | 25 | 12.5 | 25 | 50 | 12.5 | 25 |
| PRT835 | 50 | 25 | 12.5 | 50 | 25 | 25 | 25 | 50 | 12.5 | 25 |
| PRT836 | 12.5 | 50 | 12.5 | 50 | 12.5 | 25 | 12.5 | 25 | 25 | 12.5 |
| PRT837 | 12.5 | 25 | 25 | 12.5 | 25 | 12.5 | 25 | 12.5 | 12.5 | 12.5 |
| PRT838 | 12.5 | 50 | 12.5 | 25 | 50 | 25 | 12.5 | 25 | 12.5 | 25 |
| PRT839 | 25 | 12.5 | 12.5 | 12.5 | 12.5 | 25 | 50 | 25 | 12.5 | 50 |
| PRT840 | 12.5 | 25 | 25 | 12.5 | 25 | 12.5 | 25 | 12.5 | 25 | 25 |
| PRT841 | 25 | 12.5 | 50 | 12.5 | 50 | 12.5 | 50 | 12.5 | 50 | 12.5 |
| PRT842 | 12.5 | 25 | 25 | 12.5 | 25 | 12.5 | 25 | 12.5 | 12.5 | 25 |
| PRT843 | 12.5 | 12.5 | 12.5 | 25 | 50 | 25 | 12.5 | 25 | 25 | 50 |
| PRT844 | 25 | 50 | 12.5 | 50 | 12.5 | 50 | 25 | 12.5 | 12.5 | 25 |
| PRT845 | 12.5 | 25 | 25 | 12.5 | 25 | 25 | 25 | 12.5 | 12.5 | 50 |
| PRT846 | 12.5 | 25 | 50 | 12.5 | 12.5 | 12.5 | 12.5 | 12.5 | 12.5 | 12.5 |
| PRT847 | 25 | 12.5 | 12.5 | 25 | 12.5 | 25 | 12.5 | 12.5 | 12.5 | 12.5 |
| PRT848 | 12.5 | 25 | 25 | 50 | 12.5 | 50 | 12.5 | 50 | 25 | 12.5 |
| PRT849 | 12.5 | 12.5 | 12.5 | 12.5 | 25 | 12.5 | 25 | 12.5 | 12.5 | 25 |
| PRT850 | 25 | 12.5 | 50 | 12.5 | 50 | 12.5 | 50 | 12.5 | 25 | 50 |
| PRT851 | 12.5 | 25 | 12.5 | 12.5 | 12.5 | 12.5 | 12.5 | 25 | 12.5 | 25 |
| PRT852 | 25 | 12.5 | 25 | 50 | 12.5 | 50 | 12.5 | 50 | 12.5 | 50 |
| PRT853 | 12.5 | 25 | 50 | 25 | 12.5 | 25 | 50 | 25 | 25 | 12.5 |
| PRT854 | 12.5 | 100 | 12.5 | 12.5 | 12.5 | 12.5 | 50 | 12.5 | 50 | 12.5 |
| PRT855 | 12.5 | 50 | 25 | 12.5 | 50 | 12.5 | 12.5 | 12.5 | 12.5 | 12.5 |
| PRT856 | 12.5 | 12.5 | 12.5 | 25 | 12.5 | 25 | 50 | 25 | 25 | 12.5 |
| PRT857 | 50 | 25 | 25 | 12.5 | 50 | 12.5 | 12.5 | 12.5 | 12.5 | 25 |
| PRT858 | 25 | 12.5 | 12.5 | 12.5 | 50 | 25 | 12.5 | 25 | 50 | 12.5 |
| PRT859 | 25 | 12.5 | 25 | 25 | 25 | 50 | 25 | 12.5 | 25 | 50 |
| PRT860 | 12.5 | 25 | 50 | 12.5 | 50 | 12.5 | 50 | 12.5 | 50 | 100 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT861 | 12.5 | 12.5 | 25 | 12.5 | 25 | 12.5 | 25 | 12.5 | 25 | 12.5 |
| PRT862 | 25 | 12.5 | 50 | 12.5 | 50 | 25 | 12.5 | 50 | 12.5 | 25 |
| PRT863 | 12.5 | 25 | 50 | 12.5 | 12.5 | 12.5 | 12.5 | 12.5 | 25 | 12.5 |
| PRT864 | 12.5 | 12.5 | 25 | 50 | 25 | 12.5 | 25 | 50 | 12.5 | 50 |
| PRT865 | 12.5 | 25 | 50 | 12.5 | 50 | 12.5 | 50 | 25 | 12.5 | 12.5 |
| PRT866 | 12.5 | 25 | 12.5 | 12.5 | 12.5 | 12.5 | 12.5 | 12.5 | 25 | 12.5 |
| PRT867 | 25 | 12.5 | 50 | 25 | 12.5 | 25 | 50 | 25 | 12.5 | 50 |
| PRT868 | 50 | 12.5 | 25 | 50 | 25 | 12.5 | 25 | 50 | 12.5 | 12.5 |
| PRT869 | 25 | 12.5 | 12.5 | 12.5 | 12.5 | 12.5 | 12.5 | 12.5 | 12.5 | 50 |
| PRT870 | 50 | 100 | 50 | 25 | 12.5 | 25 | 50 | 25 | 12.5 | 50 |
| PRT871 | 25 | 50 | 12.5 | 12.5 | 12.5 | 12.5 | 25 | 12.5 | 50 | 12.5 |
| PRT872 | 50 | 25 | 12.5 | 25 | 50 | 12.5 | 50 | 12.5 | 50 | 25 |
| PRT873 | 50 | 12.5 | 25 | 25 | 50 | 25 | 12.5 | 25 | 50 | 12.5 |
| PRT874 | 25 | 12.5 | 12.5 | 12.5 | 12.5 | 12.5 | 25 | 12.5 | 12.5 | 12.5 |
| PRT875 | 12.5 | 25 | 50 | 12.5 | 50 | 12.5 | 25 | 50 | 12.5 | 12.5 |
| PRT876 | 12.5 | 12.5 | 12.5 | 25 | 12.5 | 25 | 12.5 | 25 | 25 | 25 |
| PRT877 | 12.5 | 25 | 25 | 12.5 | 25 | 12.5 | 50 | 12.5 | 50 | 12.5 |
| PRT878 | 25 | 12.5 | 50 | 12.5 | 50 | 12.5 | 25 | 50 | 25 | 12.5 |
| PRT879 | 50 | 12.5 | 12.5 | 25 | 12.5 | 25 | 12.5 | 12.5 | 12.5 | 25 |
| PRT880 | 12.5 | 25 | 12.5 | 12.5 | 12.5 | 50 | 12.5 | 50 | 12.5 | 50 |
| PRT881 | 12.5 | 12.5 | 25 | 12.5 | 25 | 12.5 | 25 | 12.5 | 25 | 12.5 |
| PRT882 | 12.5 | 25 | 12.5 | 25 | 100 | 50 | 12.5 | 50 | 12.5 | 50 |
| PRT883 | 25 | 50 | 25 | 12.5 | 25 | 50 | 25 | 12.5 | 50 | 12.5 |
| PRT884 | 12.5 | 12.5 | 12.5 | 12.5 | 12.5 | 12.5 | 12.5 | 25 | 50 | 25 |
| PRT885 | 12.5 | 50 | 25 | 12.5 | 25 | 50 | 25 | 12.5 | 25 | 12.5 |
| PRT886 | 12.5 | 25 | 12.5 | 25 | 12.5 | 25 | 12.5 | 25 | 12.5 | 25 |
| PRT887 | 25 | 12.5 | 25 | 50 | 25 | 12.5 | 25 | 50 | 12.5 | 50 |
| PRT888 | 50 | 12.5 | 50 | 25 | 12.5 | 25 | 12.5 | 25 | 25 | 12.5 |
| PRT889 | 12.5 | 25 | 12.5 | 12.5 | 12.5 | 12.5 | 12.5 | 25 | 12.5 | 25 |
| PRT890 | 12.5 | 50 | 25 | 12.5 | 25 | 50 | 25 | 12.5 | 50 | 12.5 |
| PRT891 | 25 | 12.5 | 25 | 12.5 | 25 | 12.5 | 25 | 12.5 | 25 | 50 |
| PRT892 | 12.5 | 25 | 25 | 50 | 12.5 | 50 | 12.5 | 50 | 25 | 25 |
| PRT893 | 25 | 50 | 25 | 12.5 | 25 | 50 | 25 | 12.5 | 50 | 12.5 |
| PRT894 | 50 | 12.5 | 50 | 12.5 | 50 | 12.5 | 50 | 12.5 | 50 | 12.5 |
| PRT895 | 25 | 12.5 | 50 | 12.5 | 50 | 12.5 | 50 | 12.5 | 25 | 25 |
| PRT896 | 50 | 25 | 12.5 | 50 | 12.5 | 50 | 12.5 | 25 | 50 | 12.5 |
| PRT897 | 25 | 12.5 | 50 | 12.5 | 50 | 12.5 | 50 | 25 | 12.5 | 25 |
| PRT898 | 50 | 25 | 12.5 | 50 | 12.5 | 12.5 | 12.5 | 12.5 | 25 | 12.5 |
| PRT899 | 12.5 | 12.5 | 12.5 | 50 | 12.5 | 50 | 12.5 | 50 | 12.5 | 12.5 |
| PRT900 | 25 | 12.5 | 12.5 | 12.5 | 12.5 | 12.5 | 25 | 12.5 | 25 | 50 |
| PRT901 | 25 | 12.5 | 50 | 25 | 12.5 | 25 | 50 | 25 | 12.5 | 25 |
| PRT902 | 25 | 12.5 | 25 | 50 | 12.5 | 50 | 25 | 12.5 | 25 | 50 |
| PRT903 | 50 | 12.5 | 25 | 50 | 12.5 | 50 | 12.5 | 25 | 50 | 12.5 |
| PRT904 | 12.5 | 25 | 12.5 | 12.5 | 25 | 12.5 | 25 | 12.5 | 25 | 25 |
| PRT905 | 50 | 12.5 | 25 | 50 | 12.5 | 50 | 25 | 12.5 | 50 | 12.5 |
| PRT906 | 25 | 12.5 | 25 | 50 | 12.5 | 25 | 50 | 25 | 12.5 | 25 |
| PRT907 | 12.5 | 12.5 | 25 | 12.5 | 12.5 | 12.5 | 12.5 | 25 | 25 | 12.5 |
| PRT908 | 12.5 | 25 | 50 | 100 | 25 | 50 | 12.5 | 25 | 25 | 25 |
| PRT909 | 25 | 12.5 | 50 | 25 | 12.5 | 50 | 25 | 12.5 | 50 | 12.5 |
| PRT910 | 25 | 12.5 | 25 | 50 | 12.5 | 25 | 12.5 | 25 | 25 | 25 |
| PRT911 | 12.5 | 25 | 50 | 25 | 12.5 | 50 | 12.5 | 50 | 12.5 | 50 |
| PRT912 | 12.5 | 25 | 50 | 25 | 100 | 50 | 12.5 | 50 | 100 | 50 |
| PRT913 | 25 | 50 | 25 | 12.5 | 25 | 25 | 50 | 25 | 12.5 | 50 |
| PRT914 | 25 | 12.5 | 12.5 | 25 | 12.5 | 12.5 | 12.5 | 12.5 | 12.5 | 12.5 |
| PRT915 | 25 | 50 | 25 | 12.5 | 25 | 25 | 50 | 25 | 25 | 25 |
| PRT916 | 12.5 | 50 | 25 | 12.5 | 50 | 25 | 12.5 | 25 | 50 | 12.5 |
| PRT917 | 50 | 12.5 | 25 | 50 | 25 | 12.5 | 50 | 25 | 25 | 25 |
| PRT918 | 50 | 12.5 | 50 | 25 | 12.5 | 50 | 25 | 12.5 | 50 | 100 |
| PRT919 | 12.5 | 50 | 12.5 | 25 | 50 | 25 | 12.5 | 25 | 25 | 50 |
| PRT920 | 25 | 25 | 50 | 12.5 | 25 | 50 | 12.5 | 50 | 12.5 | 50 |
| PRT921 | 12.5 | 25 | 12.5 | 12.5 | 25 | 12.5 | 25 | 12.5 | 25 | 12.5 |
| PRT922 | 25 | 12.5 | 12.5 | 25 | 25 | 25 | 25 | 50 | 25 | 12.5 |
| PRT923 | 50 | 25 | 25 | 12.5 | 50 | 25 | 12.5 | 25 | 50 | 25 |
| PRT924 | 25 | 50 | 12.5 | 25 | 50 | 12.5 | 50 | 25 | 12.5 | 50 |
| PRT925 | 25 | 50 | 25 | 12.5 | 50 | 25 | 12.5 | 25 | 50 | 12.5 |
| PRT926 | 50 | 25 | 12.5 | 25 | 50 | 12.5 | 25 | 50 | 25 | 12.5 |
| PRT927 | 50 | 25 | 12.5 | 25 | 50 | 12.5 | 50 | 25 | 12.5 | 50 |
| PRT928 | 12.5 | 25 | 12.5 | 25 | 25 | 12.5 | 12.5 | 12.5 | 25 | 25 |
| PRT929 | 25 | 12.5 | 25 | 50 | 25 | 12.5 | 50 | 12.5 | 50 | 12.5 |
| PRT930 | 12.5 | 25 | 50 | 12.5 | 25 | 25 | 50 | 25 | 12.5 | 50 |
| PRT931 | 25 | 50 | 25 | 12.5 | 25 | 50 | 12.5 | 50 | 25 | 12.5 |
| PRT932 | 50 | 12.5 | 12.5 | 25 | 12.5 | 25 | 12.5 | 25 | 12.5 | 12.5 |
| PRT933 | 25 | 12.5 | 50 | 25 | 12.5 | 25 | 50 | 25 | 12.5 | 50 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT934 | 25 | 50 | 12.5 | 50 | 25 | 25 | 12.5 | 50 | 12.5 | 50 |
| PRT935 | 25 | 25 | 12.5 | 25 | 25 | 100 | 12.5 | 12.5 | 12.5 | 12.5 |
| PRT936 | 12.5 | 25 | 50 | 12.5 | 25 | 50 | 12.5 | 50 | 12.5 | 50 |
| PRT937 | 12.5 | 50 | 25 | 12.5 | 50 | 25 | 12.5 | 50 | 12.5 | 50 |
| PRT938 | 50 | 25 | 12.5 | 25 | 50 | 12.5 | 50 | 12.5 | 50 | 12.5 |
| PRT939 | 25 | 12.5 | 12.5 | 50 | 12.5 | 50 | 12.5 | 50 | 12.5 | 50 |
| PRT940 | 12.5 | 25 | 12.5 | 12.5 | 50 | 12.5 | 50 | 12.5 | 50 | 12.5 |
| PRT941 | 50 | 12.5 | 50 | 12.5 | 50 | 12.5 | 50 | 12.5 | 50 | 12.5 |
| PRT942 | 50 | 12.5 | 50 | 12.5 | 25 | 50 | 12.5 | 50 | 12.5 | 50 |
| PRT943 | 12.5 | 12.5 | 12.5 | 25 | 12.5 | 12.5 | 12.5 | 12.5 | 12.5 | 50 |
| PRT944 | 25 | 50 | 100 | 50 | 12.5 | 50 | 12.5 | 25 | 50 | 12.5 |
| PRT945 | 50 | 25 | 12.5 | 25 | 50 | 12.5 | 25 | 50 | 12.5 | 25 |
| PRT946 | 12.5 | 50 | 12.5 | 50 | 25 | 12.5 | 50 | 25 | 12.5 | 50 |
| PRT947 | 50 | 12.5 | 50 | 12.5 | 50 | 25 | 12.5 | 25 | 50 | 12.5 |
| PRT948 | 12.5 | 50 | 12.5 | 50 | 25 | 12.5 | 50 | 25 | 12.5 | 50 |
| PRT949 | 25 | 50 | 25 | 12.5 | 50 | 12.5 | 25 | 50 | 12.5 | 25 |
| PRT950 | 12.5 | 50 | 25 | 12.5 | 50 | 25 | 12.5 | 50 | 25 | 12.5 |
| PRT951 | 25 | 25 | 25 | 12.5 | 12.5 | 25 | 12.5 | 25 | 50 | 100 |
| PRT952 | 12.5 | 50 | 12.5 | 50 | 12.5 | 50 | 25 | 12.5 | 25 | 12.5 |
| PRT953 | 12.5 | 12.5 | 25 | 12.5 | 25 | 12.5 | 25 | 50 | 25 | 12.5 |
| PRT954 | 25 | 12.5 | 25 | 50 | 12.5 | 25 | 50 | 25 | 12.5 | 25 |
| PRT955 | 12.5 | 25 | 12.5 | 25 | 12.5 | 25 | 12.5 | 12.5 | 25 | 12.5 |
| PRT956 | 12.5 | 12.5 | 25 | 12.5 | 25 | 25 | 12.5 | 25 | 50 | 25 |
| PRT957 | 25 | 50 | 25 | 12.5 | 25 | 50 | 12.5 | 25 | 50 | 12.5 |
| PRT958 | 12.5 | 25 | 50 | 25 | 25 | 12.5 | 50 | 25 | 12.5 | 25 |
| PRT959 | 50 | 25 | 12.5 | 25 | 50 | 12.5 | 50 | 12.5 | 25 | 50 |
| PRT960 | 50 | 25 | 12.5 | 25 | 50 | 12.5 | 12.5 | 12.5 | 25 | 12.5 |
| PRT961 | 25 | 100 | 25 | 12.5 | 12.5 | 25 | 25 | 50 | 12.5 | 25 |
| PRT962 | 50 | 25 | 12.5 | 25 | 50 | 12.5 | 25 | 50 | 12.5 | 25 |
| PRT963 | 50 | 25 | 12.5 | 25 | 50 | 25 | 12.5 | 50 | 25 | 25 |
| PRT964 | 25 | 50 | 25 | 12.5 | 25 | 50 | 25 | 25 | 12.5 | 50 |
| PRT965 | 25 | 50 | 25 | 12.5 | 50 | 25 | 12.5 | 50 | 25 | 12.5 |
| PRT966 | 12.5 | 50 | 25 | 12.5 | 50 | 25 | 12.5 | 50 | 25 | 12.5 |
| PRT967 | 12.5 | 12.5 | 25 | 12.5 | 25 | 12.5 | 25 | 12.5 | 25 | 12.5 |
| PRT968 | 12.5 | 25 | 12.5 | 25 | 25 | 12.5 | 25 | 50 | 25 | 12.5 |
| PRT969 | 12.5 | 25 | 50 | 25 | 25 | 12.5 | 25 | 50 | 25 | 12.5 |
| PRT970 | 25 | 12.5 | 25 | 50 | 12.5 | 25 | 50 | 25 | 12.5 | 25 |
| PRT971 | 12.5 | 50 | 100 | 25 | 50 | 12.5 | 25 | 50 | 12.5 | 25 |
| PRT972 | 12.5 | 25 | 50 | 25 | 12.5 | 25 | 50 | 25 | 12.5 | 25 |
| PRT973 | 12.5 | 12.5 | 50 | 12.5 | 25 | 50 | 12.5 | 50 | 25 | 12.5 |
| PRT974 | 50 | 12.5 | 50 | 12.5 | 50 | 25 | 12.5 | 50 | 25 | 12.5 |
| PRT975 | 12.5 | 50 | 12.5 | 25 | 50 | 12.5 | 12.5 | 50 | 12.5 | 25 |
| PRT976 | 12.5 | 50 | 12.5 | 50 | 12.5 | 25 | 25 | 50 | 25 | 25 |
| PRT977 | 50 | 12.5 | 50 | 12.5 | 25 | 50 | 25 | 12.5 | 50 | 25 |
| PRT978 | 50 | 12.5 | 50 | 12.5 | 25 | 50 | 12.5 | 25 | 50 | 12.5 |
| PRT979 | 12.5 | 50 | 12.5 | 50 | 12.5 | 100 | 25 | 12.5 | 25 | 12.5 |
| PRT980 | 50 | 12.5 | 50 | 12.5 | 50 | 25 | 12.5 | 50 | 12.5 | 50 |
| PRT981 | 12.5 | 50 | 12.5 | 50 | 12.5 | 25 | 25 | 12.5 | 50 | 12.5 |
| PRT982 | 25 | 12.5 | 50 | 12.5 | 25 | 50 | 12.5 | 50 | 12.5 | 50 |
| PRT983 | 12.5 | 25 | 50 | 12.5 | 25 | 50 | 12.5 | 50 | 12.5 | 25 |
| PRT984 | 12.5 | 25 | 50 | 25 | 12.5 | 12.5 | 12.5 | 50 | 25 | 12.5 |
| PRT985 | 12.5 | 50 | 12.5 | 25 | 50 | 25 | 12.5 | 50 | 12.5 | 50 |
| PRT986 | 50 | 12.5 | 50 | 12.5 | 25 | 50 | 25 | 12.5 | 25 | 50 |
| PRT987 | 12.5 | 25 | 50 | 25 | 12.5 | 50 | 12.5 | 50 | 12.5 | 50 |
| PRT988 | 50 | 12.5 | 50 | 12.5 | 50 | 12.5 | 50 | 12.5 | 50 | 12.5 |
| PRT989 | 12.5 | 50 | 12.5 | 12.5 | 12.5 | 100 | 100 | 12.5 | 12.5 | 25 |
| PRT990 | 25 | 12.5 | 12.5 | 50 | 12.5 | 25 | 50 | 25 | 12.5 | 25 |
| PRT991 | 25 | 12.5 | 25 | 50 | 12.5 | 50 | 12.5 | 25 | 12.5 | 25 |
| PRT992 | 12.5 | 12.5 | 12.5 | 25 | 25 | 25 | 25 | 25 | 12.5 | 25 |
| PRT993 | 50 | 12.5 | 50 | 12.5 | 50 | 12.5 | 50 | 12.5 | 50 | 12.5 |
| PRT994 | 12.5 | 25 | 50 | 25 | 12.5 | 50 | 25 | 25 | 50 | 25 |
| PRT995 | 50 | 12.5 | 50 | 12.5 | 50 | 25 | 12.5 | 25 | 50 | 12.5 |
| PRT996 | 12.5 | 25 | 12.5 | 12.5 | 100 | 12.5 | 25 | 12.5 | 25 | 12.5 |
| PRT997 | 12.5 | 12.5 | 12.5 | 50 | 12.5 | 50 | 12.5 | 25 | 50 | 25 |
| PRT998 | 50 | 12.5 | 50 | 12.5 | 50 | 25 | 25 | 25 | 50 | 25 |
| PRT999 | 50 | 25 | 12.5 | 25 | 50 | 12.5 | 25 | 50 | 25 | 12.5 |
| PRT1000 | 12.5 | 50 | 25 | 12.5 | 25 | 50 | 25 | 12.5 | 25 | 50 |
| PRT1001 | 50 | 12.5 | 50 | 25 | 12.5 | 50 | 25 | 12.5 | 25 | 50 |
| PRT1002 | 12.5 | 25 | 50 | 12.5 | 50 | 25 | 12.5 | 25 | 50 | 12.5 |
| PRT1003 | 12.5 | 25 | 50 | 25 | 25 | 12.5 | 25 | 50 | 25 | 12.5 |
| PRT1004 | 100 | 50 | 12.5 | 50 | 25 | 12.5 | 25 | 50 | 25 | 12.5 |
| PRT1005 | 12.5 | 50 | 12.5 | 25 | 50 | 25 | 12.5 | 25 | 50 | 25 |
| PRT1006 | 50 | 12.5 | 50 | 12.5 | 50 | 25 | 12.5 | 25 | 50 | 25 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT1007 | 12.5 | 25 | 50 | 12.5 | 50 | 12.5 | 50 | 25 | 12.5 | 25 |
| PRT1008 | 12.5 | 12.5 | 12.5 | 50 | 12.5 | 50 | 12.5 | 25 | 50 | 25 |
| PRT1009 | 12.5 | 50 | 12.5 | 50 | 25 | 12.5 | 25 | 50 | 25 | 100 |
| PRT1010 | 12.5 | 50 | 12.5 | 50 | 12.5 | 50 | 25 | 12.5 | 25 | 50 |
| PRT1011 | 50 | 12.5 | 50 | 12.5 | 50 | 25 | 12.5 | 25 | 50 | 25 |
| PRT1012 | 50 | 12.5 | 12.5 | 50 | 12.5 | 50 | 12.5 | 12.5 | 25 | 12.5 |
| PRT1013 | 12.5 | 12.5 | 25 | 12.5 | 12.5 | 12.5 | 25 | 12.5 | 25 | 50 |
| PRT1014 | 25 | 50 | 25 | 12.5 | 50 | 12.5 | 50 | 12.5 | 50 | 25 |
| PRT1015 | 50 | 12.5 | 50 | 12.5 | 25 | 50 | 12.5 | 50 | 12.5 | 50 |
| PRT1016 | 25 | 50 | 25 | 12.5 | 25 | 50 | 100 | 50 | 25 | 12.5 |
| PRT1017 | 12.5 | 12.5 | 12.5 | 12.5 | 12.5 | 12.5 | 12.5 | 50 | 12.5 | 50 |
| PRT1018 | 12.5 | 50 | 12.5 | 25 | 50 | 12.5 | 50 | 12.5 | 50 | 25 |
| PRT1019 | 50 | 12.5 | 25 | 50 | 12.5 | 50 | 12.5 | 50 | 12.5 | 25 |
| PRT1020 | 12.5 | 12.5 | 25 | 12.5 | 12.5 | 12.5 | 12.5 | 12.5 | 50 | 25 |
| PRT1021 | 12.5 | 25 | 50 | 25 | 12.5 | 50 | 12.5 | 50 | 12.5 | 50 |
| PRT1022 | 50 | 12.5 | 25 | 25 | 25 | 50 | 12.5 | 50 | 12.5 | 12.5 |
| PRT1023 | 12.5 | 25 | 12.5 | 25 | 12.5 | 25 | 12.5 | 12.5 | 50 | 12.5 |
| PRT1024 | 12.5 | 50 | 25 | 12.5 | 25 | 50 | 25 | 12.5 | 50 | 12.5 |
| PRT1025 | 25 | 12.5 | 25 | 50 | 100 | 50 | 25 | 12.5 | 25 | 50 |
| PRT1026 | 25 | 50 | 25 | 12.5 | 50 | 12.5 | 50 | 12.5 | 25 | 50 |
| PRT1027 | 25 | 12.5 | 25 | 50 | 12.5 | 50 | 12.5 | 50 | 12.5 | 50 |
| PRT1028 | 50 | 25 | 50 | 25 | 25 | 12.5 | 25 | 50 | 25 | 50 |
| PRT1029 | 12.5 | 50 | 12.5 | 50 | 12.5 | 50 | 12.5 | 50 | 12.5 | 50 |
| PRT1030 | 12.5 | 50 | 12.5 | 50 | 25 | 50 | 12.5 | 50 | 12.5 | 50 |
| PRT1031 | 50 | 12.5 | 50 | 12.5 | 50 | 25 | 12.5 | 12.5 | 50 | 12.5 |
| PRT1032 | 12.5 | 50 | 12.5 | 50 | 12.5 | 25 | 50 | 25 | 12.5 | 25 |
| PRT1033 | 12.5 | 50 | 25 | 50 | 12.5 | 50 | 100 | 50 | 25 | 50 |
| PRT1034 | 50 | 25 | 12.5 | 50 | 50 | 50 | 12.5 | 50 | 12.5 | 50 |
| PRT1035 | 50 | 12.5 | 25 | 25 | 50 | 12.5 | 25 | 12.5 | 25 | 50 |
| PRT1036 | 50 | 25 | 25 | 50 | 12.5 | 50 | 12.5 | 50 | 50 | 50 |
| PRT1037 | 50 | 50 | 12.5 | 25 | 25 | 50 | 25 | 12.5 | 50 | 50 |
| PRT1038 | 12.5 | 50 | 50 | 50 | 12.5 | 25 | 50 | 50 | 12.5 | 25 |
| PRT1039 | 50 | 50 | 12.5 | 25 | 50 | 50 | 12.5 | 50 | 12.5 | 50 |
| PRT1040 | 50 | 50 | 25 | 50 | 12.5 | 50 | 25 | 50 | 25 | 50 |
| PRT1041 | 25 | 50 | 25 | 50 | 50 | 12.5 | 50 | 25 | 50 | 25 |
| PRT1042 | 50 | 12.5 | 25 | 50 | 50 | 50 | 12.5 | 50 | 25 | 50 |
| PRT1043 | 12.5 | 25 | 50 | 25 | 25 | 50 | 25 | 12.5 | 50 | 50 |
| PRT1044 | 50 | 50 | 12.5 | 50 | 50 | 50 | 25 | 12.5 | 25 | 50 |
| PRT1045 | 50 | 25 | 50 | 12.5 | 50 | 50 | 50 | 12.5 | 50 | 50 |
| PRT1046 | 25 | 50 | 25 | 25 | 12.5 | 50 | 50 | 50 | 25 | 12.5 |
| PRT1047 | 50 | 25 | 50 | 25 | 12.5 | 50 | 12.5 | 12.5 | 12.5 | 12.5 |
| PRT1048 | 25 | 50 | 25 | 12.5 | 25 | 50 | 25 | 12.5 | 50 | 12.5 |
| PRT1049 | 25 | 12.5 | 25 | 12.5 | 12.5 | 12.5 | 12.5 | 50 | 12.5 | 50 |
| PRT1050 | 12.5 | 25 | 12.5 | 25 | 25 | 12.5 | 12.5 | 12.5 | 50 | 12.5 |
| PRT1051 | 12.5 | 25 | 12.5 | 25 | 12.5 | 12.5 | 12.5 | 50 | 12.5 | 50 |
| PRT1052 | 25 | 50 | 25 | 12.5 | 50 | 12.5 | 50 | 12.5 | 12.5 | 12.5 |
| PRT1053 | 12.5 | 12.5 | 50 | 12.5 | 50 | 12.5 | 12.5 | 100 | 12.5 | 100 |
| PRT1054 | 25 | 12.5 | 25 | 12.5 | 12.5 | 12.5 | 12.5 | 25 | 50 | 25 |
| PRT1055 | 50 | 12.5 | 50 | 12.5 | 50 | 25 | 12.5 | 25 | 50 | 12.5 |
| PRT1056 | 25 | 12.5 | 25 | 50 | 12.5 | 50 | 12.5 | 50 | 12.5 | 25 |
| PRT1057 | 50 | 25 | 12.5 | 25 | 50 | 25 | 12.5 | 25 | 50 | 25 |
| PRT1058 | 25 | 50 | 25 | 12.5 | 50 | 12.5 | 50 | 12.5 | 50 | 12.5 |
| PRT1059 | 12.5 | 50 | 12.5 | 25 | 25 | 50 | 12.5 | 12.5 | 25 | 12.5 |
| PRT1060 | 12.5 | 25 | 50 | 25 | 12.5 | 50 | 12.5 | 25 | 12.5 | 25 |
| PRT1061 | 12.5 | 12.5 | 12.5 | 12.5 | 12.5 | 12.5 | 50 | 25 | 12.5 | 25 |
| PRT1062 | 50 | 25 | 12.5 | 25 | 25 | 50 | 25 | 12.5 | 25 | 50 |
| PRT1063 | 25 | 50 | 25 | 12.5 | 50 | 12.5 | 50 | 25 | 25 | 12.5 |
| PRT1064 | 50 | 25 | 12.5 | 50 | 25 | 12.5 | 25 | 50 | 25 | 12.5 |
| PRT1065 | 25 | 12.5 | 25 | 12.5 | 50 | 12.5 | 50 | 25 | 12.5 | 25 |
| PRT1066 | 12.5 | 12.5 | 12.5 | 12.5 | 50 | 25 | 100 | 25 | 50 | 12.5 |
| PRT1067 | 50 | 25 | 12.5 | 25 | 25 | 25 | 12.5 | 25 | 50 | 25 |
| PRT1068 | 50 | 25 | 12.5 | 25 | 50 | 25 | 12.5 | 25 | 50 | 25 |
| PRT1069 | 50 | 12.5 | 25 | 50 | 12.5 | 50 | 25 | 12.5 | 25 | 25 |
| PRT1070 | 12.5 | 25 | 12.5 | 25 | 12.5 | 12.5 | 12.5 | 12.5 | 12.5 | 12.5 |
| PRT1071 | 25 | 12.5 | 25 | 50 | 25 | 12.5 | 50 | 12.5 | 50 | 12.5 |
| PRT1072 | 12.5 | 12.5 | 25 | 50 | 12.5 | 50 | 12.5 | 12.5 | 12.5 | 12.5 |
| PRT1073 | 12.5 | 25 | 12.5 | 25 | 12.5 | 25 | 12.5 | 12.5 | 50 | 12.5 |
| PRT1074 | 12.5 | 50 | 12.5 | 12.5 | 12.5 | 12.5 | 12.5 | 12.5 | 12.5 | 12.5 |
| PRT1075 | 12.5 | 25 | 50 | 25 | 25 | 50 | 25 | 50 | 12.5 | 50 |
| PRT1076 | 25 | 12.5 | 25 | 12.5 | 12.5 | 12.5 | 12.5 | 25 | 12.5 | 25 |
| PRT1077 | 12.5 | 12.5 | 50 | 25 | 25 | 25 | 25 | 25 | 50 | 12.5 |
| PRT1078 | 50 | 25 | 12.5 | 25 | 50 | 12.5 | 50 | 12.5 | 50 | 12.5 |
| PRT1079 | 12.5 | 50 | 12.5 | 50 | 12.5 | 50 | 12.5 | 50 | 50 | 12.5 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT1080 | 25 | 12.5 | 25 | 50 | 12.5 | 12.5 | 12.5 | 12.5 | 25 | 50 |
| PRT1081 | 12.5 | 50 | 12.5 | 50 | 12.5 | 50 | 12.5 | 25 | 50 | 12.5 |
| PRT1082 | 12.5 | 25 | 50 | 25 | 12.5 | 25 | 50 | 25 | 12.5 | 25 |
| PRT1083 | 12.5 | 50 | 50 | 50 | 25 | 12.5 | 50 | 25 | 50 | 25 |
| PRT1084 | 12.5 | 50 | 50 | 50 | 12.5 | 12.5 | 25 | 12.5 | 25 | 12.5 |
| PRT1085 | 12.5 | 12.5 | 50 | 12.5 | 50 | 12.5 | 50 | 12.5 | 50 | 25 |
| PRT1086 | 25 | 50 | 25 | 12.5 | 25 | 50 | 25 | 12.5 | 50 | 12.5 |
| PRT1087 | 12.5 | 50 | 50 | 50 | 12.5 | 25 | 50 | 25 | 25 | 25 |
| PRT1088 | 50 | 50 | 12.5 | 50 | 50 | 50 | 25 | 12.5 | 25 | 50 |
| PRT1089 | 25 | 50 | 25 | 12.5 | 50 | 25 | 12.5 | 25 | 50 | 25 |
| PRT1090 | 12.5 | 50 | 12.5 | 50 | 12.5 | 25 | 50 | 25 | 12.5 | 25 |
| PRT1091 | 50 | 12.5 | 25 | 50 | 25 | 12.5 | 25 | 50 | 25 | 12.5 |
| PRT1092 | 50 | 25 | 12.5 | 25 | 12.5 | 12.5 | 25 | 50 | 25 | 25 |
| PRT1093 | 50 | 12.5 | 50 | 12.5 | 50 | 25 | 12.5 | 25 | 50 | 12.5 |
| PRT1094 | 50 | 25 | 12.5 | 25 | 50 | 12.5 | 50 | 12.5 | 50 | 12.5 |
| PRT1095 | 12.5 | 50 | 25 | 12.5 | 25 | 25 | 50 | 25 | 12.5 | 50 |
| PRT1096 | 50 | 50 | 50 | 12.5 | 50 | 50 | 12.5 | 12.5 | 12.5 | 25 |
| PRT1097 | 12.5 | 25 | 12.5 | 25 | 12.5 | 25 | 100 | 25 | 12.5 | 25 |
| PRT1098 | 12.5 | 12.5 | 12.5 | 12.5 | 25 | 12.5 | 25 | 12.5 | 25 | 50 |
| PRT1099 | 50 | 12.5 | 50 | 12.5 | 50 | 25 | 12.5 | 25 | 50 | 12.5 |
| PRT1100 | 25 | 100 | 25 | 12.5 | 100 | 12.5 | 12.5 | 12.5 | 25 | 12.5 |
| PRT1101 | 50 | 25 | 12.5 | 25 | 50 | 12.5 | 25 | 50 | 25 | 12.5 |
| PRT1102 | 12.5 | 12.5 | 12.5 | 12.5 | 12.5 | 12.5 | 12.5 | 12.5 | 12.5 | 25 |
| PRT1103 | 25 | 12.5 | 25 | 50 | 25 | 12.5 | 25 | 50 | 25 | 12.5 |
| PRT1104 | 12.5 | 50 | 12.5 | 25 | 50 | 25 | 12.5 | 25 | 50 | 25 |
| PRT1105 | 25 | 50 | 12.5 | 50 | 25 | 12.5 | 25 | 50 | 12.5 | 50 |
| PRT1106 | 25 | 12.5 | 25 | 50 | 12.5 | 25 | 50 | 25 | 12.5 | 50 |
| PRT1107 | 50 | 12.5 | 50 | 25 | 12.5 | 50 | 12.5 | 50 | 12.5 | 25 |
| PRT1108 | 12.5 | 12.5 | 12.5 | 25 | 25 | 12.5 | 25 | 12.5 | 25 | 12.5 |
| PRT1109 | 25 | 12.5 | 25 | 12.5 | 50 | 12.5 | 25 | 50 | 25 | 12.5 |
| PRT1110 | 50 | 25 | 12.5 | 50 | 12.5 | 50 | 12.5 | 25 | 50 | 25 |
| PRT1111 | 50 | 12.5 | 50 | 25 | 25 | 12.5 | 25 | 50 | 25 | 12.5 |
| PRT1112 | 25 | 12.5 | 25 | 50 | 12.5 | 25 | 12.5 | 25 | 12.5 | 25 |
| PRT1113 | 12.5 | 12.5 | 12.5 | 12.5 | 12.5 | 50 | 12.5 | 25 | 50 | 25 |
| PRT1114 | 12.5 | 25 | 50 | 25 | 25 | 12.5 | 25 | 50 | 25 | 12.5 |
| PRT1115 | 25 | 12.5 | 50 | 12.5 | 12.5 | 12.5 | 12.5 | 12.5 | 12.5 | 12.5 |
| PRT1116 | 12.5 | 25 | 12.5 | 25 | 25 | 12.5 | 25 | 50 | 25 | 12.5 |
| PRT1117 | 12.5 | 50 | 12.5 | 50 | 12.5 | 25 | 12.5 | 25 | 12.5 | 25 |
| PRT1118 | 12.5 | 25 | 12.5 | 25 | 12.5 | 12.5 | 50 | 12.5 | 25 | 50 |
| PRT1119 | 25 | 50 | 25 | 12.5 | 25 | 50 | 25 | 12.5 | 25 | 50 |
| PRT1120 | 12.5 | 25 | 50 | 25 | 12.5 | 50 | 12.5 | 50 | 12.5 | 12.5 |
| PRT1121 | 25 | 50 | 25 | 12.5 | 50 | 25 | 12.5 | 25 | 50 | 12.5 |
| PRT1122 | 12.5 | 50 | 12.5 | 50 | 25 | 12.5 | 50 | 12.5 | 50 | 12.5 |
| PRT1123 | 50 | 25 | 12.5 | 25 | 50 | 12.5 | 25 | 50 | 25 | 12.5 |
| PRT1124 | 50 | 25 | 12.5 | 25 | 50 | 12.5 | 50 | 12.5 | 50 | 12.5 |
| PRT1125 | 12.5 | 12.5 | 12.5 | 12.5 | 12.5 | 12.5 | 12.5 | 12.5 | 12.5 | 25 |
| PRT1126 | 50 | 25 | 12.5 | 25 | 25 | 50 | 12.5 | 50 | 12.5 | 50 |
| PRT1127 | 50 | 12.5 | 50 | 12.5 | 50 | 25 | 12.5 | 25 | 50 | 25 |
| PRT1128 | 50 | 12.5 | 50 | 12.5 | 50 | 12.5 | 50 | 12.5 | 50 | 12.5 |
| PRT1129 | 12.5 | 50 | 12.5 | 12.5 | 25 | 12.5 | 12.5 | 12.5 | 12.5 | 12.5 |
| PRT1130 | 12.5 | 50 | 12.5 | 50 | 12.5 | 25 | 50 | 25 | 12.5 | 25 |
| PRT1131 | 12.5 | 50 | 12.5 | 50 | 25 | 12.5 | 50 | 12.5 | 50 | 12.5 |
| PRT1132 | 12.5 | 50 | 12.5 | 50 | 12.5 | 50 | 12.5 | 25 | 50 | 25 |
| PRT1133 | 12.5 | 12.5 | 12.5 | 25 | 25 | 12.5 | 25 | 12.5 | 25 | 12.5 |
| PRT1134 | 25 | 12.5 | 25 | 12.5 | 12.5 | 12.5 | 12.5 | 12.5 | 50 | 12.5 |
| PRT1135 | 50 | 100 | 50 | 25 | 25 | 12.5 | 25 | 50 | 25 | 12.5 |
| PRT1136 | 12.5 | 50 | 12.5 | 50 | 12.5 | 50 | 12.5 | 25 | 50 | 12.5 |
| PRT1137 | 50 | 25 | 12.5 | 25 | 50 | 12.5 | 50 | 12.5 | 50 | 12.5 |
| PRT1138 | 50 | 25 | 12.5 | 25 | 25 | 50 | 25 | 12.5 | 25 | 50 |
| PRT1139 | 25 | 12.5 | 25 | 50 | 12.5 | 50 | 12.5 | 50 | 12.5 | 25 |
| PRT1140 | 50 | 12.5 | 50 | 12.5 | 50 | 12.5 | 50 | 12.5 | 50 | 100 |
| PRT1141 | 12.5 | 50 | 12.5 | 50 | 12.5 | 25 | 50 | 25 | 12.5 | 25 |
| PRT1142 | 50 | 25 | 12.5 | 25 | 25 | 50 | 25 | 12.5 | 25 | 50 |
| PRT1143 | 25 | 50 | 25 | 12.5 | 50 | 12.5 | 50 | 12.5 | 50 | 12.5 |
| PRT1144 | 12.5 | 50 | 12.5 | 50 | 12.5 | 25 | 50 | 25 | 12.5 | 25 |
| PRT1145 | 25 | 12.5 | 12.5 | 12.5 | 12.5 | 12.5 | 12.5 | 50 | 25 | 12.5 |
| PRT1146 | 25 | 12.5 | 25 | 50 | 12.5 | 25 | 50 | 12.5 | 50 | 12.5 |
| PRT1147 | 12.5 | 50 | 12.5 | 50 | 25 | 25 | 12.5 | 25 | 50 | 25 |
| PRT1148 | 25 | 12.5 | 25 | 12.5 | 12.5 | 12.5 | 12.5 | 12.5 | 25 | 12.5 |
| PRT1149 | 25 | 50 | 25 | 12.5 | 50 | 12.5 | 50 | 12.5 | 25 | 50 |
| PRT1150 | 50 | 12.5 | 50 | 12.5 | 50 | 25 | 12.5 | 25 | 50 | 25 |
| PRT1151 | 12.5 | 25 | 50 | 25 | 25 | 12.5 | 25 | 50 | 12.5 | 12.5 |
| PRT1152 | 25 | 12.5 | 25 | 12.5 | 12.5 | 12.5 | 12.5 | 12.5 | 25 | 50 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT1153 | 50 | 12.5 | 50 | 12.5 | 50 | 25 | 12.5 | 25 | 50 | 12.5 |
| PRT1154 | 12.5 | 50 | 12.5 | 25 | 100 | 12.5 | 12.5 | 12.5 | 12.5 | 12.5 |
| PRT1155 | 12.5 | 25 | 12.5 | 12.5 | 25 | 12.5 | 25 | 50 | 25 | 12.5 |
| PRT1156 | 25 | 12.5 | 25 | 25 | 50 | 25 | 12.5 | 50 | 12.5 | 50 |
| PRT1157 | 25 | 50 | 25 | 12.5 | 25 | 50 | 25 | 12.5 | 25 | 50 |
| PRT1158 | 12.5 | 25 | 50 | 12.5 | 50 | 12.5 | 50 | 12.5 | 50 | 25 |
| PRT1159 | 50 | 12.5 | 50 | 12.5 | 25 | 50 | 25 | 12.5 | 25 | 12.5 |
| PRT1160 | 25 | 12.5 | 25 | 12.5 | 12.5 | 25 | 12.5 | 25 | 12.5 | 25 |
| PRT1161 | 12.5 | 12.5 | 12.5 | 25 | 25 | 50 | 25 | 12.5 | 25 | 50 |
| PRT1162 | 50 | 12.5 | 50 | 12.5 | 50 | 25 | 12.5 | 25 | 50 | 25 |
| PRT1163 | 25 | 12.5 | 25 | 12.5 | 12.5 | 12.5 | 12.5 | 12.5 | 12.5 | 25 |
| PRT1164 | 12.5 | 12.5 | 12.5 | 12.5 | 25 | 12.5 | 25 | 50 | 25 | 12.5 |
| PRT1165 | 25 | 12.5 | 25 | 50 | 25 | 12.5 | 25 | 50 | 25 | 12.5 |
| PRT1166 | 12.5 | 25 | 50 | 25 | 25 | 12.5 | 50 | 12.5 | 50 | 12.5 |
| PRT1167 | 25 | 12.5 | 25 | 50 | 25 | 12.5 | 25 | 50 | 25 | 12.5 |
| PRT1168 | 12.5 | 25 | 50 | 12.5 | 50 | 12.5 | 50 | 12.5 | 50 | 12.5 |
| PRT1169 | 25 | 50 | 25 | 12.5 | 12.5 | 50 | 12.5 | 12.5 | 12.5 | 12.5 |
| PRT1170 | 12.5 | 25 | 12.5 | 100 | 50 | 12.5 | 50 | 12.5 | 12.5 | 25 |
| PRT1171 | 12.5 | 25 | 12.5 | 12.5 | 12.5 | 12.5 | 50 | 12.5 | 50 | 25 |
| PRT1172 | 25 | 50 | 25 | 12.5 | 12.5 | 12.5 | 12.5 | 12.5 | 12.5 | 12.5 |
| PRT1173 | 25 | 12.5 | 25 | 12.5 | 12.5 | 50 | 12.5 | 50 | 12.5 | 50 |
| PRT1174 | 50 | 12.5 | 50 | 12.5 | 50 | 12.5 | 50 | 12.5 | 25 | 50 |
| PRT1175 | 25 | 50 | 25 | 12.5 | 50 | 25 | 12.5 | 25 | 50 | 25 |
| PRT1176 | 50 | 12.5 | 50 | 12.5 | 25 | 50 | 12.5 | 50 | 25 | 12.5 |
| PRT1177 | 12.5 | 50 | 12.5 | 50 | 12.5 | 50 | 12.5 | 50 | 12.5 | 25 |
| PRT1178 | 12.5 | 25 | 50 | 12.5 | 25 | 12.5 | 25 | 12.5 | 25 | 12.5 |
| PRT1179 | 50 | 25 | 12.5 | 50 | 25 | 12.5 | 25 | 50 | 25 | 12.5 |
| PRT1180 | 12.5 | 50 | 25 | 12.5 | 50 | 25 | 12.5 | 25 | 50 | 25 |
| PRT1181 | 50 | 12.5 | 50 | 25 | 25 | 12.5 | 50 | 100 | 50 | 25 |
| PRT1182 | 25 | 50 | 25 | 25 | 12.5 | 50 | 12.5 | 50 | 12.5 | 25 |
| PRT1183 | 50 | 25 | 12.5 | 50 | 25 | 12.5 | 25 | 50 | 25 | 12.5 |
| PRT1184 | 25 | 12.5 | 25 | 50 | 12.5 | 25 | 50 | 25 | 12.5 | 25 |
| PRT1185 | 12.5 | 25 | 50 | 12.5 | 50 | 12.5 | 50 | 12.5 | 50 | 12.5 |
| PRT1186 | 25 | 12.5 | 25 | 50 | 25 | 12.5 | 50 | 12.5 | 50 | 12.5 |
| PRT1187 | 25 | 12.5 | 25 | 25 | 12.5 | 12.5 | 12.5 | 25 | 12.5 | 12.5 |
| PRT1188 | 12.5 | 25 | 12.5 | 12.5 | 50 | 12.5 | 25 | 50 | 12.5 | 25 |
| PRT1189 | 12.5 | 25 | 50 | 12.5 | 25 | 50 | 12.5 | 25 | 50 | 12.5 |
| PRT1190 | 12.5 | 25 | 12.5 | 50 | 12.5 | 25 | 50 | 25 | 12.5 | 50 |
| PRT1191 | 25 | 50 | 25 | 25 | 25 | 12.5 | 50 | 25 | 12.5 | 50 |
| PRT1192 | 12.5 | 25 | 50 | 25 | 12.5 | 50 | 25 | 12.5 | 50 | 25 |
| PRT1193 | 12.5 | 12.5 | 25 | 12.5 | 12.5 | 25 | 12.5 | 50 | 25 | 12.5 |
| PRT1194 | 12.5 | 50 | 12.5 | 25 | 50 | 25 | 100 | 25 | 50 | 12.5 |
| PRT1195 | 50 | 25 | 12.5 | 50 | 12.5 | 50 | 25 | 12.5 | 25 | 50 |
| PRT1196 | 50 | 12.5 | 25 | 25 | 25 | 50 | 25 | 12.5 | 25 | 50 |
| PRT1197 | 12.5 | 25 | 50 | 12.5 | 50 | 25 | 12.5 | 25 | 50 | 25 |
| PRT1198 | 12.5 | 25 | 50 | 12.5 | 50 | 25 | 12.5 | 50 | 25 | 12.5 |
| PRT1199 | 12.5 | 50 | 12.5 | 50 | 25 | 25 | 12.5 | 25 | 50 | 25 |
| PRT1200 | 12.5 | 12.5 | 12.5 | 25 | 25 | 12.5 | 50 | 25 | 12.5 | 50 |
| PRT1201 | 50 | 12.5 | 25 | 50 | 25 | 12.5 | 50 | 25 | 12.5 | 25 |
| PRT1202 | 12.5 | 25 | 50 | 12.5 | 50 | 12.5 | 50 | 12.5 | 25 | 50 |
| PRT1203 | 12.5 | 50 | 25 | 12.5 | 50 | 12.5 | 50 | 12.5 | 25 | 50 |
| PRT1204 | 25 | 50 | 25 | 12.5 | 50 | 25 | 25 | 12.5 | 50 | 25 |
| PRT1205 | 12.5 | 50 | 25 | 12.5 | 50 | 12.5 | 25 | 50 | 12.5 | 25 |
| PRT1206 | 12.5 | 25 | 50 | 12.5 | 50 | 25 | 12.5 | 50 | 25 | 25 |
| PRT1207 | 25 | 12.5 | 12.5 | 25 | 25 | 12.5 | 25 | 25 | 12.5 | 12.5 |
| PRT1208 | 25 | 12.5 | 25 | 12.5 | 50 | 25 | 12.5 | 50 | 25 | 12.5 |
| PRT1209 | 12.5 | 25 | 50 | 25 | 12.5 | 25 | 12.5 | 12.5 | 25 | 12.5 |
| PRT1210 | 12.5 | 25 | 12.5 | 25 | 25 | 12.5 | 25 | 12.5 | 25 | 12.5 |
| PRT1211 | 25 | 12.5 | 25 | 50 | 25 | 12.5 | 25 | 50 | 25 | 12.5 |
| PRT1212 | 25 | 12.5 | 50 | 25 | 25 | 12.5 | 25 | 50 | 25 | 12.5 |
| PRT1213 | 25 | 50 | 25 | 100 | 50 | 25 | 12.5 | 25 | 50 | 25 |
| PRT1214 | 12.5 | 50 | 25 | 12.5 | 50 | 12.5 | 25 | 50 | 12.5 | 25 |
| PRT1215 | 50 | 12.5 | 25 | 50 | 12.5 | 25 | 50 | 25 | 12.5 | 25 |
| PRT1216 | 12.5 | 50 | 12.5 | 25 | 25 | 50 | 12.5 | 50 | 25 | 12.5 |
| PRT1217 | 12.5 | 50 | 12.5 | 25 | 50 | 25 | 12.5 | 50 | 25 | 12.5 |
| PRT1218 | 25 | 25 | 12.5 | 12.5 | 12.5 | 25 | 12.5 | 12.5 | 12.5 | 25 |
| PRT1219 | 50 | 25 | 12.5 | 50 | 12.5 | 25 | 25 | 50 | 25 | 25 |
| PRT1220 | 25 | 50 | 12.5 | 25 | 25 | 50 | 25 | 12.5 | 50 | 25 |
| PRT1221 | 12.5 | 25 | 25 | 50 | 25 | 12.5 | 50 | 25 | 12.5 | 50 |
| PRT1222 | 25 | 50 | 12.5 | 25 | 50 | 12.5 | 25 | 50 | 25 | 12.5 |
| PRT1223 | 25 | 12.5 | 50 | 25 | 100 | 25 | 50 | 12.5 | 50 | 12.5 |
| PRT1224 | 50 | 25 | 12.5 | 25 | 50 | 12.5 | 25 | 50 | 12.5 | 50 |
| PRT1225 | 12.5 | 25 | 50 | 25 | 25 | 12.5 | 50 | 12.5 | 50 | 12.5 |

TABLE 3-continued

MIC (µg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT1226 | 50 | 25 | 12.5 | 25 | 25 | 50 | 12.5 | 50 | 12.5 | 25 |
| PRT1227 | 25 | 12.5 | 25 | 12.5 | 12.5 | 12.5 | 12.5 | 12.5 | 25 | 12.5 |
| PRT1228 | 25 | 50 | 25 | 12.5 | 25 | 50 | 25 | 12.5 | 25 | 50 |
| PRT1229 | 12.5 | 12.5 | 12.5 | 25 | 12.5 | 12.5 | 12.5 | 12.5 | 12.5 | 12.5 |
| PRT1230 | 25 | 12.5 | 12.5 | 25 | 12.5 | 12.5 | 12.5 | 50 | 12.5 | 50 |
| PRT1231 | 25 | 50 | 12.5 | 50 | 100 | 50 | 12.5 | 50 | 12.5 | 25 |
| PRT1232 | 25 | 25 | 12.5 | 25 | 50 | 25 | 12.5 | 25 | 50 | 25 |
| PRT1233 | 12.5 | 25 | 50 | 12.5 | 50 | 12.5 | 50 | 25 | 12.5 | 25 |
| PRT1234 | 50 | 12.5 | 25 | 50 | 25 | 25 | 25 | 25 | 12.5 | 25 |
| PRT1235 | 12.5 | 25 | 12.5 | 25 | 12.5 | 12.5 | 12.5 | 12.5 | 50 | 12.5 |
| PRT1236 | 25 | 12.5 | 50 | 12.5 | 50 | 12.5 | 12.5 | 25 | 12.5 | 25 |
| PRT1237 | 12.5 | 25 | 12.5 | 12.5 | 12.5 | 25 | 50 | 25 | 12.5 | 50 |
| PRT1238 | 12.5 | 50 | 12.5 | 50 | 12.5 | 50 | 25 | 12.5 | 25 | 50 |
| PRT1239 | 12.5 | 50 | 12.5 | 50 | 12.5 | 50 | 12.5 | 25 | 50 | 25 |
| PRT1240 | 50 | 12.5 | 12.5 | 25 | 12.5 | 25 | 50 | 25 | 12.5 | 25 |
| PRT1241 | 25 | 12.5 | 50 | 12.5 | 50 | 12.5 | 25 | 50 | 25 | 12.5 |
| PRT1242 | 50 | 25 | 12.5 | 25 | 25 | 50 | 25 | 12.5 | 25 | 50 |
| PRT1243 | 50 | 12.5 | 50 | 12.5 | 50 | 12.5 | 25 | 50 | 25 | 12.5 |
| PRT1244 | 12.5 | 50 | 12.5 | 12.5 | 50 | 25 | 12.5 | 25 | 50 | 12.5 |
| PRT1245 | 12.5 | 50 | 12.5 | 50 | 25 | 12.5 | 25 | 50 | 25 | 12.5 |
| PRT1246 | 25 | 12.5 | 25 | 50 | 25 | 12.5 | 25 | 50 | 25 | 12.5 |
| PRT1247 | 12.5 | 12.5 | 25 | 12.5 | 12.5 | 25 | 12.5 | 25 | 12.5 | 25 |
| PRT1248 | 25 | 25 | 25 | 12.5 | 12.5 | 25 | 12.5 | 25 | 12.5 | 25 |
| PRT1249 | 12.5 | 50 | 12.5 | 50 | 12.5 | 50 | 12.5 | 25 | 50 | 25 |
| PRT1250 | 50 | 12.5 | 25 | 50 | 12.5 | 50 | 12.5 | 25 | 50 | 25 |
| PRT1251 | 25 | 50 | 25 | 12.5 | 25 | 50 | 25 | 12.5 | 25 | 50 |
| PRT1252 | 50 | 25 | 12.5 | 25 | 50 | 12.5 | 25 | 50 | 25 | 12.5 |
| PRT1253 | 12.5 | 50 | 25 | 12.5 | 50 | 25 | 12.5 | 25 | 50 | 25 |
| PRT1254 | 25 | 50 | 25 | 12.5 | 50 | 12.5 | 50 | 12.5 | 25 | 50 |
| PRT1255 | 50 | 25 | 12.5 | 25 | 50 | 12.5 | 25 | 50 | 25 | 12.5 |
| PRT1256 | 12.5 | 25 | 12.5 | 25 | 50 | 12.5 | 50 | 12.5 | 50 | 25 |
| PRT1257 | 50 | 25 | 12.5 | 25 | 25 | 50 | 12.5 | 50 | 12.5 | 50 |
| PRT1258 | 25 | 50 | 25 | 12.5 | 25 | 50 | 12.5 | 50 | 25 | 12.5 |
| PRT1259 | 50 | 25 | 12.5 | 25 | 50 | 12.5 | 50 | 12.5 | 50 | 12.5 |
| PRT1260 | 50 | 25 | 12.5 | 25 | 50 | 12.5 | 50 | 12.5 | 50 | 25 |
| PRT1261 | 25 | 50 | 25 | 12.5 | 50 | 12.5 | 50 | 12.5 | 12.5 | 25 |
| PRT1262 | 25 | 12.5 | 25 | 12.5 | 50 | 12.5 | 50 | 12.5 | 50 | 25 |
| PRT1263 | 50 | 12.5 | 25 | 50 | 12.5 | 50 | 12.5 | 50 | 12.5 | 50 |
| PRT1264 | 50 | 12.5 | 25 | 12.5 | 25 | 12.5 | 50 | 12.5 | 50 | 12.5 |
| PRT1265 | 50 | 25 | 12.5 | 25 | 50 | 25 | 12.5 | 12.5 | 50 | 12.5 |
| PRT1266 | 12.5 | 25 | 50 | 25 | 25 | 12.5 | 25 | 50 | 12.5 | 50 |
| PRT1267 | 25 | 50 | 25 | 12.5 | 50 | 12.5 | 25 | 50 | 25 | 12.5 |
| PRT1268 | 12.5 | 50 | 12.5 | 25 | 50 | 12.5 | 50 | 12.5 | 25 | 50 |
| PRT1269 | 50 | 25 | 12.5 | 25 | 50 | 12.5 | 50 | 12.5 | 50 | 12.5 |
| PRT1270 | 12.5 | 50 | 12.5 | 50 | 25 | 12.5 | 25 | 50 | 25 | 12.5 |
| PRT1271 | 50 | 12.5 | 50 | 12.5 | 50 | 12.5 | 50 | 12.5 | 50 | 12.5 |
| PRT1272 | 50 | 100 | 50 | 25 | 12.5 | 50 | 12.5 | 50 | 12.5 | 50 |
| PRT1273 | 50 | 12.5 | 50 | 12.5 | 50 | 25 | 12.5 | 50 | 12.5 | 50 |
| PRT1274 | 50 | 12.5 | 50 | 12.5 | 50 | 25 | 12.5 | 25 | 50 | 25 |
| PRT1275 | 50 | 12.5 | 50 | 12.5 | 50 | 50 | 12.5 | 50 | 25 | 12.5 |
| PRT1276 | 12.5 | 50 | 12.5 | 50 | 12.5 | 50 | 12.5 | 50 | 12.5 | 50 |
| PRT1277 | 50 | 12.5 | 50 | 12.5 | 50 | 12.5 | 25 | 12.5 | 25 | 12.5 |
| PRT1278 | 12.5 | 12.5 | 12.5 | 12.5 | 12.5 | 12.5 | 12.5 | 12.5 | 12.5 | 12.5 |
| PRT1279 | 25 | 12.5 | 50 | 12.5 | 25 | 50 | 25 | 12.5 | 50 | 12.5 |
| PRT1280 | 50 | 25 | 12.5 | 50 | 12.5 | 50 | 12.5 | 50 | 12.5 | 25 |
| PRT1281 | 12.5 | 25 | 50 | 25 | 12.5 | 50 | 12.5 | 50 | 12.5 | 50 |
| PRT1282 | 50 | 12.5 | 50 | 25 | 12.5 | 50 | 25 | 12.5 | 25 | 50 |
| PRT1283 | 50 | 12.5 | 50 | 12.5 | 12.5 | 50 | 12.5 | 25 | 12.5 | 25 |
| PRT1284 | 50 | 25 | 12.5 | 25 | 12.5 | 12.5 | 50 | 12.5 | 25 | 12.5 |
| PRT1285 | 12.5 | 12.5 | 100 | 12.5 | 25 | 12.5 | 25 | 50 | 12.5 | 50 |
| PRT1286 | 50 | 12.5 | 50 | 12.5 | 50 | 12.5 | 25 | 50 | 25 | 12.5 |
| PRT1287 | 25 | 12.5 | 50 | 12.5 | 50 | 12.5 | 50 | 12.5 | 50 | 50 |
| PRT1288 | 25 | 12.5 | 25 | 50 | 12.5 | 12.5 | 50 | 12.5 | 25 | 12.5 |
| PRT1289 | 12.5 | 12.5 | 12.5 | 25 | 12.5 | 12.5 | 50 | 12.5 | 50 | 25 |
| PRT1290 | 12.5 | 50 | 12.5 | 50 | 25 | 12.5 | 25 | 50 | 12.5 | 12.5 |
| PRT1291 | 100 | 25 | 50 | 25 | 12.5 | 50 | 12.5 | 50 | 12.5 | 12.5 |
| PRT1292 | 12.5 | 12.5 | 12.5 | 50 | 25 | 12.5 | 50 | 12.5 | 50 | 12.5 |
| PRT1293 | 12.5 | 25 | 50 | 12.5 | 50 | 12.5 | 12.5 | 50 | 12.5 | 12.5 |
| PRT1294 | 12.5 | 50 | 12.5 | 50 | 12.5 | 50 | 12.5 | 50 | 12.5 | 50 |
| PRT1295 | 50 | 12.5 | 50 | 12.5 | 50 | 12.5 | 50 | 12.5 | 50 | 12.5 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT1296 | 12.5 | 25 | 50 | 25 | 100 | 50 | 12.5 | 25 | 50 | 25 |
| PRT1297 | 50 | 12.5 | 25 | 50 | 12.5 | 25 | 50 | 25 | 12.5 | 50 |
| PRT1298 | 50 | 12.5 | 50 | 25 | 12.5 | 50 | 12.5 | 50 | 12.5 | 25 |
| PRT1299 | 50 | 25 | 12.5 | 12.5 | 12.5 | 25 | 12.5 | 25 | 50 | 25 |
| PRT1300 | 50 | 25 | 12.5 | 25 | 50 | 12.5 | 12.5 | 12.5 | 12.5 | 12.5 |
| PRT1301 | 12.5 | 12.5 | 12.5 | 50 | 25 | 12.5 | 50 | 12.5 | 25 | 50 |
| PRT1302 | 50 | 12.5 | 50 | 25 | 12.5 | 50 | 12.5 | 25 | 50 | 25 |
| PRT1303 | 50 | 12.5 | 50 | 12.5 | 50 | 12.5 | 12.5 | 25 | 12.5 | 25 |
| PRT1304 | 12.5 | 25 | 12.5 | 12.5 | 25 | 12.5 | 25 | 12.5 | 25 | 12.5 |
| PRT1305 | 50 | 12.5 | 50 | 12.5 | 50 | 12.5 | 50 | 25 | 25 | 12.5 |
| PRT1306 | 50 | 12.5 | 50 | 12.5 | 25 | 50 | 25 | 12.5 | 25 | 50 |
| PRT1307 | 50 | 12.5 | 50 | 100 | 50 | 12.5 | 50 | 25 | 12.5 | 25 |
| PRT1308 | 12.5 | 50 | 12.5 | 50 | 12.5 | 25 | 50 | 25 | 12.5 | 50 |
| PRT1309 | 50 | 12.5 | 50 | 12.5 | 50 | 25 | 12.5 | 25 | 50 | 25 |
| PRT1310 | 50 | 12.5 | 25 | 50 | 12.5 | 25 | 50 | 25 | 12.5 | 25 |
| PRT1311 | 25 | 12.5 | 25 | 50 | 12.5 | 50 | 25 | 12.5 | 25 | 25 |
| PRT1312 | 12.5 | 50 | 12.5 | 50 | 12.5 | 50 | 12.5 | 50 | 12.5 | 50 |
| PRT1313 | 25 | 50 | 25 | 12.5 | 25 | 50 | 12.5 | 50 | 12.5 | 50 |
| PRT1314 | 50 | 12.5 | 50 | 12.5 | 50 | 12.5 | 12.5 | 12.5 | 12.5 | 12.5 |
| PRT1315 | 12.5 | 12.5 | 100 | 25 | 12.5 | 12.5 | 50 | 12.5 | 50 | 12.5 |
| PRT1316 | 12.5 | 50 | 25 | 12.5 | 50 | 12.5 | 50 | 12.5 | 50 | 12.5 |
| PRT1317 | 12.5 | 50 | 25 | 12.5 | 25 | 50 | 25 | 12.5 | 50 | 12.5 |
| PRT1318 | 12.5 | 25 | 50 | 25 | 12.5 | 50 | 12.5 | 25 | 50 | 25 |
| PRT1319 | 50 | 12.5 | 25 | 25 | 25 | 12.5 | 25 | 25 | 12.5 | 12.5 |
| PRT1320 | 12.5 | 25 | 12.5 | 25 | 12.5 | 12.5 | 12.5 | 12.5 | 50 | 12.5 |
| PRT1321 | 12.5 | 50 | 25 | 12.5 | 50 | 12.5 | 50 | 12.5 | 100 | 12.5 |
| PRT1322 | 25 | 12.5 | 25 | 50 | 12.5 | 50 | 12.5 | 12.5 | 25 | 12.5 |
| PRT1323 | 25 | 12.5 | 25 | 12.5 | 12.5 | 50 | 12.5 | 25 | 50 | 12.5 |
| PRT1324 | 25 | 50 | 25 | 12.5 | 50 | 25 | 12.5 | 25 | 12.5 | 25 |
| PRT1325 | 12.5 | 25 | 12.5 | 25 | 25 | 12.5 | 12.5 | 25 | 12.5 | 25 |
| PRT1326 | 12.5 | 50 | 12.5 | 50 | 12.5 | 50 | 25 | 12.5 | 25 | 50 |
| PRT1327 | 12.5 | 50 | 12.5 | 50 | 12.5 | 12.5 | 12.5 | 12.5 | 12.5 | 25 |
| PRT1328 | 12.5 | 50 | 12.5 | 50 | 25 | 12.5 | 25 | 50 | 12.5 | 50 |
| PRT1329 | 50 | 12.5 | 50 | 12.5 | 50 | 25 | 12.5 | 25 | 25 | 25 |
| PRT1330 | 12.5 | 12.5 | 12.5 | 50 | 12.5 | 50 | 25 | 12.5 | 25 | 50 |
| PRT1331 | 50 | 25 | 12.5 | 50 | 12.5 | 25 | 50 | 25 | 12.5 | 25 |
| PRT1332 | 12.5 | 50 | 25 | 12.5 | 50 | 25 | 12.5 | 25 | 12.5 | 25 |
| PRT1333 | 12.5 | 25 | 25 | 12.5 | 25 | 12.5 | 25 | 12.5 | 25 | 12.5 |
| PRT1334 | 12.5 | 50 | 12.5 | 50 | 12.5 | 50 | 25 | 100 | 25 | 25 |
| PRT1335 | 12.5 | 50 | 12.5 | 50 | 12.5 | 25 | 50 | 25 | 12.5 | 50 |
| PRT1336 | 50 | 12.5 | 50 | 25 | 12.5 | 50 | 12.5 | 50 | 12.5 | 50 |
| PRT1337 | 50 | 12.5 | 25 | 50 | 25 | 25 | 12.5 | 25 | 50 | 12.5 |
| PRT1338 | 25 | 12.5 | 25 | 50 | 12.5 | 12.5 | 12.5 | 12.5 | 12.5 | 25 |
| PRT1339 | 12.5 | 12.5 | 25 | 12.5 | 50 | 25 | 12.5 | 25 | 50 | 25 |
| PRT1340 | 50 | 25 | 12.5 | 25 | 25 | 50 | 25 | 12.5 | 25 | 50 |
| PRT1341 | 50 | 12.5 | 50 | 12.5 | 12.5 | 25 | 12.5 | 25 | 12.5 | 50 |
| PRT1342 | 12.5 | 25 | 50 | 12.5 | 50 | 12.5 | 50 | 12.5 | 25 | 50 |
| PRT1343 | 25 | 50 | 25 | 25 | 12.5 | 50 | 25 | 12.5 | 25 | 50 |
| PRT1344 | 50 | 25 | 12.5 | 25 | 50 | 12.5 | 50 | 12.5 | 50 | 25 |
| PRT1345 | 25 | 50 | 25 | 12.5 | 25 | 50 | 25 | 12.5 | 25 | 50 |
| PRT1346 | 25 | 50 | 25 | 12.5 | 50 | 25 | 12.5 | 25 | 50 | 25 |
| PRT1347 | 12.5 | 25 | 50 | 25 | 25 | 12.5 | 25 | 50 | 100 | 12.5 |
| PRT1348 | 12.5 | 25 | 12.5 | 25 | 50 | 25 | 12.5 | 25 | 50 | 12.5 |
| PRT1349 | 25 | 12.5 | 25 | 50 | 12.5 | 50 | 12.5 | 50 | 12.5 | 25 |
| PRT1350 | 12.5 | 50 | 12.5 | 50 | 25 | 12.5 | 25 | 50 | 25 | 12.5 |
| PRT1351 | 25 | 50 | 25 | 12.5 | 12.5 | 12.5 | 25 | 12.5 | 25 | 12.5 |
| PRT1352 | 12.5 | 12.5 | 12.5 | 12.5 | 12.5 | 50 | 12.5 | 25 | 50 | 25 |
| PRT1353 | 25 | 50 | 25 | 12.5 | 25 | 50 | 25 | 12.5 | 25 | 50 |
| PRT1354 | 12.5 | 25 | 50 | 25 | 12.5 | 25 | 50 | 25 | 12.5 | 25 |
| PRT1355 | 25 | 12.5 | 25 | 50 | 12.5 | 50 | 12.5 | 25 | 50 | 25 |
| PRT1356 | 50 | 12.5 | 50 | 25 | 25 | 12.5 | 25 | 50 | 25 | 12.5 |
| PRT1357 | 12.5 | 25 | 50 | 25 | 100 | 50 | 12.5 | 12.5 | 50 | 12.5 |
| PRT1358 | 12.5 | 50 | 12.5 | 12.5 | 25 | 12.5 | 25 | 12.5 | 25 | 12.5 |
| PRT1359 | 12.5 | 25 | 25 | 25 | 12.5 | 25 | 12.5 | 25 | 12.5 | 25 |
| PRT1360 | 25 | 50 | 25 | 12.5 | 50 | 12.5 | 50 | 12.5 | 25 | 50 |
| PRT1361 | 12.5 | 25 | 50 | 12.5 | 25 | 50 | 25 | 12.5 | 25 | 50 |
| PRT1362 | 25 | 50 | 25 | 12.5 | 50 | 12.5 | 50 | 12.5 | 12.5 | 12.5 |
| PRT1363 | 12.5 | 12.5 | 12.5 | 50 | 12.5 | 25 | 50 | 25 | 12.5 | 50 |
| PRT1364 | 12.5 | 25 | 50 | 25 | 25 | 12.5 | 12.5 | 12.5 | 12.5 | 12.5 |
| PRT1365 | 100 | 25 | 50 | 25 | 12.5 | 50 | 25 | 12.5 | 25 | 12.5 |

TABLE 3-continued

MIC (μg/mL) of the human-originated EGF domain proteins against various Gram-negative bacteria

| | MIC (μg/mL) | | | | | | | | | |
|---|---|---|---|---|---|---|---|---|---|---|
| Protein | E. coli BL21 | P. aeruginosa | K. pneumonia | E. cloacae | A. hydrophila | C. diversus | M. catarrhalis | P. mirabilis | P. vulgaris | S. marcescens |
| PRT1366 | 12.5 | 12.5 | 25 | 12.5 | 12.5 | 12.5 | 12.5 | 12.5 | 12.5 | 12.5 |
| PRT1367 | 50 | 25 | 12.5 | 25 | 50 | 12.5 | 50 | 12.5 | 50 | 25 |
| PRT1368 | 25 | 12.5 | 25 | 12.5 | 25 | 12.5 | 12.5 | 12.5 | 12.5 | 12.5 |
| PRT1369 | 12.5 | 12.5 | 12.5 | 25 | 12.5 | 12.5 | 12.5 | 25 | 12.5 | 25 |
| PRT1370 | 12.5 | 25 | 50 | 25 | 25 | 12.5 | 25 | 50 | 25 | 12.5 |
| PRT1371 | 12.5 | 12.5 | 12.5 | 12.5 | 12.5 | 100 | 12.5 | 12.5 | 12.5 | 12.5 |
| PRT1372 | 25 | 12.5 | 25 | 12.5 | 25 | 12.5 | 25 | 12.5 | 25 | 12.5 |
| PRT1373 | 12.5 | 12.5 | 12.5 | 12.5 | 12.5 | 50 | 12.5 | 25 | 50 | 12.5 |
| PRT1374 | 12.5 | 25 | 12.5 | 25 | 12.5 | 12.5 | 12.5 | 12.5 | 12.5 | 12.5 |
| PRT1375 | 12.5 | 12.5 | 12.5 | 12.5 | 25 | 12.5 | 25 | 50 | 25 | 12.5 |
| PRT1376 | 12.5 | 50 | 12.5 | 50 | 12.5 | 50 | 12.5 | 50 | 12.5 | 25 |
| PRT1377 | 50 | 12.5 | 50 | 12.5 | 50 | 12.5 | 50 | 12.5 | 50 | 12.5 |
| PRT1378 | 25 | 12.5 | 25 | 12.5 | 12.5 | 25 | 12.5 | 25 | 12.5 | 25 |
| PRT1379 | 12.5 | 50 | 12.5 | 50 | 25 | 12.5 | 25 | 50 | 25 | 12.5 |
| PRT1380 | 50 | 12.5 | 50 | 12.5 | 50 | 12.5 | 50 | 50 | 50 | 50 |
| PRT1381 | 25 | 50 | 25 | 12.5 | 50 | 25 | 12.5 | 25 | 50 | 25 |
| PRT1382 | 12.5 | 50 | 100 | 50 | 12.5 | 50 | 12.5 | 12.5 | 25 | 12.5 |
| PRT1383 | 12.5 | 12.5 | 25 | 12.5 | 50 | 25 | 12.5 | 50 | 12.5 | 50 |
| PRT1384 | 12.5 | 25 | 50 | 25 | 25 | 25 | 12.5 | 25 | 50 | 25 |
| PRT1385 | 50 | 12.5 | 50 | 12.5 | 50 | 12.5 | 50 | 12.5 | 25 | 50 |
| PRT1386 | 12.5 | 25 | 12.5 | 25 | 12.5 | 12.5 | 12.5 | 12.5 | 25 | 12.5 |
| PRT1387 | 12.5 | 50 | 25 | 12.5 | 50 | 25 | 12.5 | 25 | 12.5 | 25 |
| PRT1388 | 12.5 | 12.5 | 12.5 | 12.5 | 25 | 12.5 | 25 | 12.5 | 12.5 | 12.5 |
| PRT1389 | 12.5 | 25 | 12.5 | 25 | 12.5 | 12.5 | 12.5 | 12.5 | 25 | 12.5 |
| PRT1390 | 12.5 | 12.5 | 50 | 12.5 | 50 | 25 | 50 | 25 | 50 | 50 |
| PRT1391 | 12.5 | 12.5 | 12.5 | 12.5 | 12.5 | 12.5 | 12.5 | 12.5 | 12.5 | 12.5 |
| PRT1392 | 25 | 12.5 | 25 | 12.5 | 25 | 12.5 | 25 | 12.5 | 25 | 50 |
| PRT1393 | 12.5 | 25 | 50 | 25 | 12.5 | 25 | 50 | 12.5 | 50 | 12.5 |
| PRT1394 | 12.5 | 12.5 | 50 | 12.5 | 25 | 50 | 25 | 12.5 | 25 | 50 |
| PRT1395 | 25 | 12.5 | 25 | 12.5 | 100 | 12.5 | 12.5 | 12.5 | 12.5 | 25 |
| PRT1396 | 12.5 | 12.5 | 12.5 | 25 | 25 | 12.5 | 25 | 12.5 | 25 | 12.5 |
| PRT1397 | 25 | 12.5 | 50 | 12.5 | 50 | 25 | 12.5 | 25 | 50 | 25 |
| PRT1398 | 25 | 12.5 | 25 | 50 | 25 | 12.5 | 25 | 12.5 | 25 | 12.5 |
| PRT1399 | 12.5 | 12.5 | 12.5 | 25 | 12.5 | 25 | 12.5 | 25 | 12.5 | 25 |
| PRT1400 | 12.5 | 50 | 12.5 | 25 | 50 | 12.5 | 50 | 12.5 | 12.5 | 25 |
| PRT1401 | 25 | 12.5 | 25 | 12.5 | 25 | 12.5 | 25 | 12.5 | 25 | 12.5 |
| PRT1402 | 12.5 | 25 | 12.5 | 50 | 25 | 12.5 | 25 | 50 | 25 | 12.5 |
| PRT1403 | 12.5 | 50 | 12.5 | 25 | 25 | 50 | 12.5 | 50 | 12.5 | 50 |
| PRT1404 | 25 | 50 | 25 | 12.5 | 25 | 50 | 25 | 12.5 | 25 | 50 |
| PRT1405 | 12.5 | 12.5 | 12.5 | 12.5 | 12.5 | 12.5 | 12.5 | 12.5 | 50 | 12.5 |
| PRT1406 | 50 | 25 | 12.5 | 25 | 50 | 12.5 | 50 | 12.5 | 50 | 50 |
| PRT1407 | 25 | 12.5 | 12.5 | 12.5 | 50 | 12.5 | 50 | 12.5 | 12.5 | 25 |
| PRT1408 | 12.5 | 25 | 12.5 | 25 | 12.5 | 12.5 | 12.5 | 12.5 | 12.5 | 25 |
| PRT1409 | 12.5 | 12.5 | 12.5 | 12.5 | 12.5 | 12.5 | 12.5 | 50 | 12.5 | 50 |
| PRT1410 | 12.5 | 25 | 50 | 25 | 12.5 | 50 | 100 | 50 | 12.5 | 12.5 |
| PRT1411 | 25 | 12.5 | 25 | 12.5 | 12.5 | 12.5 | 12.5 | 12.5 | 25 | 12.5 |
| PRT1412 | 50 | 25 | 12.5 | 25 | 50 | 25 | 12.5 | 25 | 50 | 25 |
| PRT1413 | 25 | 50 | 25 | 12.5 | 25 | 50 | 12.5 | 50 | 25 | 12.5 |
| PRT1414 | 12.5 | 50 | 12.5 | 50 | 12.5 | 12.5 | 50 | 12.5 | 12.5 | 25 |
| PRT1415 | 12.5 | 25 | 12.5 | 25 | 25 | 50 | 25 | 12.5 | 25 | 50 |
| PRT1416 | 12.5 | 25 | 50 | 25 | 25 | 12.5 | 25 | 12.5 | 25 | 12.5 |
| PRT1417 | 12.5 | 12.5 | 50 | 12.5 | 50 | 25 | 12.5 | 25 | 50 | 25 |
| PRT1418 | 12.5 | 25 | 50 | 25 | 25 | 12.5 | 50 | 12.5 | 50 | 25 |
| PRT1419 | 50 | 100 | 50 | 12.5 | 50 | 12.5 | 50 | 12.5 | 12.5 | 25 |
| PRT1420 | 12.5 | 12.5 | 12.5 | 12.5 | 25 | 12.5 | 25 | 12.5 | 25 | 50 |
| PRT1421 | 50 | 12.5 | 50 | 12.5 | 50 | 25 | 12.5 | 25 | 12.5 | 25 |
| PRT1422 | 12.5 | 12.5 | 50 | 12.5 | 50 | 12.5 | 50 | 12.5 | 50 | 12.5 |
| PRT1423 | 12.5 | 12.5 | 12.5 | 12.5 | 12.5 | 25 | 50 | 12.5 | 50 | 12.5 |
| PRT1424 | 12.5 | 50 | 12.5 | 50 | 12.5 | 25 | 50 | 25 | 12.5 | 25 |
| PRT1425 | 50 | 12.5 | 50 | 25 | 12.5 | 50 | 12.5 | 12.5 | 12.5 | 12.5 |
| PRT1426 | 25 | 12.5 | 25 | 12.5 | 12.5 | 25 | 12.5 | 25 | 12.5 | 25 |
| PRT1427 | 12.5 | 12.5 | 12.5 | 25 | 25 | 25 | 12.5 | 25 | 12.5 | 25 |
| PRT1428 | 12.5 | 12.5 | 12.5 | 12.5 | 12.5 | 12.5 | 12.5 | 50 | 12.5 | 25 |
| PRT1429 | 50 | 25 | 12.5 | 25 | 25 | 50 | 25 | 12.5 | 25 | 12.5 |
| PRT1430 | 12.5 | 25 | 12.5 | 25 | 12.5 | 25 | 12.5 | 25 | 12.5 | 25 |
| PRT1431 | 25 | 12.5 | 25 | 50 | 12.5 | 50 | 12.5 | 50 | 12.5 | 50 |
| PRT1432 | 12.5 | 50 | 12.5 | 50 | 25 | 12.5 | 25 | 50 | 25 | 12.5 |
| PRT1433 | 12.5 | 12.5 | 12.5 | 12.5 | 25 | 12.5 | 25 | 12.5 | 12.5 | 12.5 |
| PRT1434 | 12.5 | 25 | 100 | 25 | 12.5 | 25 | 12.5 | 25 | 12.5 | 12.5 |
| PRT1435 | 25 | 12.5 | 25 | 50 | 25 | 12.5 | 50 | 25 | 12.5 | 12.5 |
| PRT1436 | 12.5 | 12.5 | 50 | 12.5 | 50 | 25 | 25 | 12.5 | 25 | 12.5 |
| PRT1437 | 25 | 12.5 | 12.5 | 12.5 | 12.5 | 12.5 | 12.5 | 25 | 12.5 | 50 |
| PRT1438 | 25 | 50 | 25 | 12.5 | 25 | 50 | 12.5 | 50 | 25 | 12.5 |

TABLE 3-continued

MIC (μg/mL) of the human-originated EGF domain proteins against various Gram-negative bacteria

| Protein | E. coli BL21 | P. aeruginosa | K. pneumonia | E. cloacae | A. hydrophila | C. diversus | M. catarrhalis | P. mirabilis | P. vulgaris | S. marcescens |
|---|---|---|---|---|---|---|---|---|---|---|
| PRT1439 | 12.5 | 50 | 12.5 | 50 | 12.5 | 50 | 12.5 | 50 | 12.5 | 50 |
| PRT1440 | 25 | 12.5 | 25 | 12.5 | 25 | 25 | 12.5 | 25 | 12.5 | 25 |
| PRT1441 | 25 | 12.5 | 25 | 12.5 | 25 | 100 | 12.5 | 12.5 | 25 | 12.5 |
| PRT1442 | 12.5 | 12.5 | 50 | 12.5 | 25 | 25 | 50 | 25 | 12.5 | 25 |
| PRT1443 | 50 | 25 | 12.5 | 25 | 50 | 25 | 25 | 12.5 | 25 | 50 |
| PRT1444 | 25 | 50 | 25 | 12.5 | 25 | 50 | 12.5 | 25 | 50 | 25 |
| PRT1445 | 12.5 | 50 | 50 | 50 | 50 | 25 | 25 | 50 | 25 | 50 |
| PRT1446 | 12.5 | 25 | 25 | 12.5 | 25 | 12.5 | 12.5 | 12.5 | 25 | 12.5 |
| PRT1447 | 25 | 12.5 | 12.5 | 12.5 | 50 | 12.5 | 50 | 25 | 12.5 | 25 |
| PRT1448 | 50 | 12.5 | 25 | 50 | 12.5 | 25 | 50 | 25 | 12.5 | 25 |
| PRT1449 | 25 | 12.5 | 50 | 12.5 | 25 | 50 | 12.5 | 50 | 12.5 | 50 |
| PRT1450 | 25 | 50 | 12.5 | 25 | 50 | 25 | 12.5 | 25 | 12.5 | 25 |
| PRT1451 | 12.5 | 25 | 12.5 | 25 | 12.5 | 25 | 12.5 | 12.5 | 12.5 | 12.5 |
| PRT1452 | 25 | 50 | 25 | 12.5 | 25 | 50 | 12.5 | 50 | 12.5 | 50 |
| PRT1453 | 12.5 | 25 | 50 | 25 | 12.5 | 25 | 50 | 12.5 | 25 | 12.5 |
| PRT1454 | 12.5 | 12.5 | 25 | 50 | 25 | 12.5 | 50 | 12.5 | 25 | 50 |
| PRT1455 | 12.5 | 25 | 25 | 12.5 | 25 | 12.5 | 12.5 | 12.5 | 12.5 | 25 |
| PRT1456 | 25 | 12.5 | 50 | 25 | 12.5 | 25 | 50 | 12.5 | 12.5 | 12.5 |
| PRT1457 | 25 | 12.5 | 100 | 12.5 | 12.5 | 12.5 | 12.5 | 25 | 12.5 | 25 |
| PRT1458 | 12.5 | 25 | 12.5 | 25 | 50 | 25 | 25 | 12.5 | 25 | 50 |
| PRT1459 | 50 | 25 | 25 | 12.5 | 25 | 50 | 12.5 | 25 | 50 | 25 |
| PRT1460 | 25 | 25 | 50 | 25 | 12.5 | 25 | 50 | 12.5 | 25 | 50 |
| PRT1461 | 12.5 | 50 | 12.5 | 25 | 12.5 | 25 | 12.5 | 25 | 12.5 | 25 |
| PRT1462 | 25 | 100 | 12.5 | 12.5 | 12.5 | 25 | 12.5 | 25 | 12.5 | 25 |
| PRT1463 | 25 | 12.5 | 25 | 50 | 12.5 | 50 | 25 | 12.5 | 25 | 12.5 |
| PRT1464 | 25 | 12.5 | 12.5 | 12.5 | 12.5 | 12.5 | 12.5 | 12.5 | 25 | 50 |
| PRT1465 | 25 | 50 | 12.5 | 25 | 50 | 25 | 12.5 | 50 | 25 | 12.5 |
| PRT1466 | 25 | 12.5 | 50 | 12.5 | 50 | 12.5 | 50 | 25 | 12.5 | 25 |
| PRT1467 | 50 | 25 | 12.5 | 50 | 25 | 12.5 | 25 | 50 | 25 | 12.5 |
| PRT1468 | 12.5 | 25 | 12.5 | 12.5 | 12.5 | 12.5 | 12.5 | 12.5 | 50 | 25 |
| PRT1469 | 12.5 | 25 | 25 | 50 | 25 | 12.5 | 50 | 100 | 50 | 12.5 |
| PRT1470 | 25 | 12.5 | 50 | 12.5 | 12.5 | 50 | 25 | 12.5 | 25 | 50 |
| PRT1471 | 25 | 50 | 12.5 | 50 | 25 | 50 | 25 | 25 | 50 | 25 |
| PRT1472 | 50 | 25 | 25 | 12.5 | 25 | 12.5 | 25 | 12.5 | 25 | 50 |
| PRT1473 | 25 | 25 | 50 | 12.5 | 50 | 12.5 | 25 | 50 | 25 | 12.5 |
| PRT1474 | 12.5 | 25 | 25 | 50 | 25 | 12.5 | 25 | 50 | 12.5 | 25 |
| PRT1475 | 12.5 | 12.5 | 12.5 | 25 | 12.5 | 25 | 12.5 | 25 | 12.5 | 12.5 |
| PRT1476 | 25 | 12.5 | 50 | 12.5 | 50 | 12.5 | 25 | 50 | 12.5 | 25 |
| PRT1477 | 12.5 | 50 | 12.5 | 25 | 50 | 25 | 12.5 | 25 | 50 | 12.5 |
| PRT1478 | 12.5 | 50 | 25 | 12.5 | 50 | 12.5 | 25 | 50 | 25 | 12.5 |
| PRT1479 | 12.5 | 50 | 100 | 50 | 12.5 | 50 | 12.5 | 25 | 50 | 12.5 |
| PRT1480 | 12.5 | 25 | 12.5 | 25 | 12.5 | 25 | 12.5 | 50 | 12.5 | 50 |
| PRT1481 | 25 | 50 | 12.5 | 50 | 25 | 12.5 | 50 | 12.5 | 50 | 25 |
| PRT1482 | 50 | 12.5 | 50 | 12.5 | 50 | 12.5 | 25 | 50 | 25 | 25 |
| PRT1483 | 25 | 50 | 25 | 12.5 | 25 | 50 | 25 | 12.5 | 25 | 25 |
| PRT1484 | 12.5 | 50 | 12.5 | 25 | 50 | 25 | 12.5 | 50 | 12.5 | 50 |
| PRT1485 | 50 | 12.5 | 12.5 | 12.5 | 50 | 12.5 | 50 | 12.5 | 12.5 | 12.5 |
| PRT1486 | 12.5 | 25 | 25 | 12.5 | 25 | 12.5 | 25 | 12.5 | 12.5 | 12.5 |
| PRT1487 | 12.5 | 25 | 50 | 25 | 12.5 | 25 | 50 | 12.5 | 50 | 12.5 |
| PRT1488 | 50 | 25 | 12.5 | 50 | 12.5 | 50 | 12.5 | 25 | 50 | 12.5 |
| PRT1489 | 50 | 25 | 25 | 12.5 | 25 | 50 | 25 | 100 | 50 | 25 |
| PRT1490 | 50 | 12.5 | 50 | 25 | 12.5 | 25 | 50 | 12.5 | 50 | 25 |
| PRT1491 | 12.5 | 25 | 50 | 25 | 12.5 | 25 | 50 | 25 | 12.5 | 50 |
| PRT1492 | 50 | 50 | 25 | 12.5 | 25 | 50 | 25 | 12.5 | 12.5 | 12.5 |
| PRT1493 | 25 | 12.5 | 12.5 | 12.5 | 50 | 50 | 25 | 50 | 25 | 50 |
| PRT1494 | 12.5 | 25 | 12.5 | 25 | 12.5 | 25 | 25 | 12.5 | 12.5 | 12.5 |
| PRT1495 | 12.5 | 25 | 25 | 12.5 | 12.5 | 50 | 50 | 50 | 25 | 25 |
| PRT1496 | 25 | 12.5 | 12.5 | 100 | 50 | 50 | 12.5 | 50 | 100 | 25 |
| PRT1497 | 25 | 12.5 | 50 | 25 | 12.5 | 25 | 50 | 25 | 50 | 12.5 |
| PRT1498 | 25 | 12.5 | 12.5 | 50 | 12.5 | 50 | 12.5 | 50 | 12.5 | 12.5 |

Conclusion: It can be known from the above table that: all of the recombinant human-originated EGF domain proteins (PRT1 to PRT1498 in Table 1) set forth in the present invention exhibit inhibitory effects on various Gram-negative bacteria, such as, E. coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris, Serratia marcescens, etc.

Example 17: Silver Staining Detection of Endotoxin (LPS) Hydrolyzed by the Human-Originated EGF Domain Proteins (PRT1 to PRT1498 in Table 1) Such as the Recombination Protein hF VII-EGF1, Etc.

1. The E. coli EH100 LPS (Sigma) samples were respectively incubated with the obtained human-originated EGF domain proteins (PRT1 to PRT1498 in Table 1) such as the recombination protein hF VII-EGF1, etc.; and the control group was the LPS sample incubated with TB S buffer. The incubation lasted overnight. Then, the centrifugation was performed to collect the pellet.

2. The 1×loading buffer for LPS (0.05 mol/L Tris-HCl, containing 10 g/L SDS, 100 g/L sucrose, 0.5% β-mercaptoethanol, 10 mg/L Bromophenol Blue, pH 6.8) was mixed with the sample of the treated pellet and incubated on a metal bath at 100° C. for 5 min.

3. 15% separating gel (containing 4 mol/L urea, Bio-Rad with a thickness of 1.0 mm, the detailed composition as follows: 1.15 mL of deionized water, 2.5 mL of 30% acrylamide, 1.3 mL of 1.5 mol/L Tris-HCl (pH 8.8, containing 10% SDS), 50 µl of 10% ammonium persulfate, 4 µl of TEMED) was mixed well and prepared. The top of the separating gel was overlaid with water.

4. 5% stacking gel was prepared as follows: 1.42 mL of deionized water, 0.33 mL of 30% acrylamide, 0.25 mL of 1 mol/L Tris-HCl (pH 6.8, containing 10% SDS), 20 µL of 10% ammonium persulfate, 2 µL of TEMED) were mixed well and poured. A ten-well comb was quickly inserted.

5. After the gel was prepared, the samples were loaded. Then, the gel was run at a voltage of 120 V to separate the samples. After running, the gel was taken to start silver staining. The gel was transferred into a tray washed thoroughly with deionized water, followed by washing the gel three times with deionized water.

6. After completion of the washing, the gel was fixed with 50 mL of fixation solution (30% alcohol, 10% glacial acetic acid, 7 g/L periodic acid) for oxidation at room temperature for 25 min After completion of the fixation, the gel was washed three times each time with deionized water for 5 min.

7. After completion of the washing, the gel was stained in 100 mL of 1 g/L $AgNO_3$ at room temperature for 40 min After completion of the staining, the gel was washed one time with $ddH_2O$.

8. The gel was transferred into 50 mL of 30 g/L $Na_2CO_3$ pre-chilled on ice, to which 0.02% formaldehyde was added just before visualization. When the band appeared or began to become dark, the reaction was stopped by adding 6 mL glacial acetic acid. The stopping solution was removed upon completion of the termination reaction and the gel was kept in deionized water.

The silver staining picture was exemplified by the protein hF VII-EGF1, as shown in FIG. 28. After treated with hF VII-EGF1, the LPS band is obviously decreased and becomes weak, indicating that the protein hF VII-EGF1 eliminates the majority of LPS. The silver staining pictures of PRT2 to PRT1498 in Table 1 are similar to that in FIG. 28. This indicated that the human-originated EGF domain proteins (PRT1 to PRT1498 in Table 1) described in the present invention can hydrolyze LPS and may be used in preparation of a medicament for treating endotoxemia caused by the Gram-negative bacteria.

SEQUENCE LISTING (1504 sequences)

SEQ ID NO: 1 - protein, 37 aa, Homo sapiens
DGDQCASSPCQNGGSCKDQLQSYICFCLPAFEGRNCE

SEQ ID NO: 2 - protein, 42 aa, Homo sapiens
DQLICVNENGGCEQYCSDHTGTKRSCRCHEGYSLLADGVSCT

SEQ ID NO: 3 - protein, 37 aa, Homo sapiens
DGDQCESNPCLNGGSCKDDINSYECWCPFGFEGKNCE

SEQ ID NO: 4 - protein, 42 aa, Homo sapiens
LDVTCNIKNGRCEQFCKNSADNKVVCSCTEGYRLAENQKSCE

SEQ ID NO: 5 - protein, 37 aa, Homo sapiens
DGDQCETSPCQNQGKCKDGLGEYTCTCLEGFEGKNCE

SEQ ID NO: 6 - protein, 41 aa, Homo sapiens
TRKLCSLDNGDCDQFCHEEQNSVVCSCARGYTLADNGKACI

SEQ ID NO: 7 - protein, 35 aa, Homo sapiens
TCLSSKEGTICSGNGVCSNELKCVCNRHWIGSDCN

SEQ ID NO: 8 - protein, 34 aa, Homo sapiens
LQFDCLPEKCNTRGVCNNRKNCHCMYGWAPPFCE

SEQ ID NO: 9 - protein, 30 aa, Homo sapiens
RCLTACHSHGVCNSNHNCHCAPGWAPPFCD

SEQ ID NO: 10 - protein, 30 aa, Homo sapiens
NCSAQCHNHGVCNHKQECHCHAGWAPPHCA

SEQ ID NO: 11 - protein, 32 aa, Homo sapiens
DCDVQKKCHGHGVCNSNKNCHCENGWAPPNCE

SEQ ID NO: 12 - protein, 35 aa, Homo sapiens
LNYDCDVQKKCHGHGVCNSNKNCHCENGWAPPNCE

SEQ ID NO: 13 - protein, 36 aa, Homo sapiens
PARSCAEEPCGAGTCKETEGHVICLCPPGYTGEHCN

SEQ ID NO: 14 - protein, 39 aa, Homo sapiens
PPKPCDSQPCFHGGTCQDWALGGGFTCSCPAGRGGAVCE

SEQ ID NO: 15 - protein, 38 aa, Homo sapiens
GDHPCLPNPCHGGAPCQNLEAGRFHCQCPPGRVGPTCA

SEQ ID NO: 16 - protein, 38 aa, Homo sapiens
EKSPCQPNPCHGAAPCRVLPEGGAQCECPLGREGTFCQ

SEQ ID NO: 17 - protein, 40 aa, Homo sapiens
AGHPCTRASGHPCLNGASCVPREAAYVCLCPGGFSGPHCE

SEQ ID NO: 18 - protein, 54 aa, Homo sapiens
CQCNPHGSYGGTCDPATGQCSCRPGVGGLRCDRCEPGFWNFRGIVTDGRSGCTP

SEQ ID NO: 19 - protein, 47 aa, Homo sapiens
CSCDPQGAVRDDCEQMTGLCSCKPGVAGPKCGQCPDGRALGPAGCEA

SEQ ID NO: 20 - protein, 42 aa, Homo sapiens
QKNLCNNTGDPEMCPENGSCVPDGPGLLQCVCADGFHGYKCM

SEQ ID NO: 21 - protein, 24 aa, Homo sapiens
NCATPCTEGCECNQGFVLSTSQCV

SEQ ID NO: 22 - protein, 36 aa, Homo sapiens
WCEDNGGCEQICTSRVDGPLCSCVTGTLQEDGKSCR

SEQ ID NO: 23 - protein, 41 aa, Homo sapiens
KKNPCNAEFQNFCIHGECKYIEHLEAVTCKCQQEYFGERCG

SEQ ID NO: 24 - protein, 37 aa, Homo sapiens
ELDLCYSNPCRNGGACARREGGYTCVCRPRFTGEDCE

SEQ ID NO: 25 - protein, 34 aa, Homo sapiens
PGVCRNGGTCTDAPNGGFRCQCPAGGAFEGPRCE

SEQ ID NO: 26 - protein, 33 aa, Homo sapiens
CDSGPCKNSGFCSERWGSFSCDCPVGFGGKDCQ

SEQ ID NO: 27 - protein, 35 aa, Homo sapiens
NACASGPCPPHADCRDLWQTFSCTCQPGYYGPGCV

SEQ ID NO: 28 - protein, 39 aa, Homo sapiens
VDACLLNPCQNQGSCRHLPGAPHGYTCDCVGGYFGHHCE

SEQ ID NO: 29 - protein, 38 aa, Homo sapiens
PCNCDVHKGFDPNCNKTNGQCHCKEFHYRPRGSDSCLP

SEQ ID NO: 30 - protein, 39 aa, Homo sapiens
PCDCYPVGSTSRSCAPHSGQCPCRPGALGRQCNSCDSPF

SEQ ID NO: 31 - protein, 46 aa, Homo sapiens
CDCYPVGSTSRSCAPHSGQCPCRPGALGRQCNSCDSPFAEVTASGC

SEQ ID NO: 32 - protein, 43 aa, Homo sapiens
RCEAQKWGPECNHLCTACMNNGVCHEDTGECICPPGFMGRTCE

SEQ ID NO: 33 - protein, 46 aa, Homo sapiens
ACELHTFGRTCKERCSGQEGCKSYVFCLPDPYGCSCATGWKGLQCN

SEQ ID NO: 34 - protein, 41 aa, Homo sapiens
ACHPGFYGPDCKLRCSCNNGEMCDRFQGCLCSPGWQGLQCE

SEQ ID NO: 35 - protein, 49 aa, Homo sapiens
AMDLCARRLLDPCEHQCDPETGRREHRAAGECLCYEGYMKDPVHKHLCI

SEQ ID NO: 36 - protein, 45 aa, Homo sapiens
PVRDCSKDNGGCSKNFRCISDRKLDSTGCVCPSGLSPMKDSSGCY

SEQ ID NO: 37 - protein, 53 aa, Homo sapiens
IGVDCSDGFNGGCEQLCLQQMAPFPDDPTLYNILMFCGCIEDYKLGVDGRSCQ

SEQ ID NO: 38 - protein, 41 aa, Homo sapiens
VRDLCGQRTTDACEQLCDPETGECSCHEGYAPDPVHRHLCV

SEQ ID NO: 39 - protein, 45 aa, Homo sapiens
PVRDCSRNNGGCTRNFKCVSDRQVDSSGCVCPEELKPMKDGSGCY

SEQ ID NO: 40 - protein, 53 aa, Homo sapiens
KGIDCSDGFNGGCEQLCLQQTLPLPYDATSSTIFMFCGCVEEYKLAPDGKSCL

SEQ ID NO: 41 - protein, 29 aa, Homo sapiens
CDRPCVNGGRCNPGTGQCVCPAGWVGEQC

SEQ ID NO: 42 - protein, 46 aa, Homo sapiens
CQCNGHSKCINQSICEKCENLTTGKHCETCISGFYGDPTNGGKCQP

SEQ ID NO: 43 - protein, 49 aa, Homo sapiens
CKCNGHASLCNTNTGKCFCTTKGVKGDECQLCEVENRYQGNPLRGTCYY

SEQ ID NO: 44 - protein, 39 aa, Homo sapiens
LYAQVSQSKPCERTGSCFSGRCVNSTCLCDPGWVGDQCQ

SEQ ID NO: 45 - protein, 39 aa, Homo sapiens
SINSCPNNCSGHGKCTTSVSVPSQVYCECDKYWKGEACD

SEQ ID NO: 46 - protein, 46 aa, Homo sapiens
CQCNGHSTCINNNVCEQCKNLTTGKQCQDCMPGYYGDPTNGGQCTA

SEQ ID NO: 47 - protein, 49 aa, Homo sapiens
CTCSGHANICHLHTGKCFCTTKGIKGDQCQLCDSENRYVGNPLRGTCYY

SEQ ID NO: 48 - protein, 38 aa, Homo sapiens
HCPTCRDRPCQNGGQCHDSESSSYVCVCPAGFTGSRCE

SEQ ID NO: 49 - protein, 39 aa, Homo sapiens
QALHCHPEACGPDATCVNRPDGRGYTCRCHLGRSGLRCE

SEQ ID NO: 50 - protein, 50 aa, Homo sapiens
CECNGHSDLCHPETGACSQCQHNAAGEFCELCAPGYYGDATAGTPEDCQP

SEQ ID NO: 51 - protein, 58 aa, Homo sapiens
CACPLTNPENMFSRTCESLGAGGYRCTACEPGYTGQYCEQCGPGYVGNPSVQGGQCLP

SEQ ID NO: 52 - protein, 50 aa, Homo sapiens
CNCNGHASSCDPVYGHCLNCQHNTEGPQCNKCKAGFFGDAMKATATSCRP

SEQ ID NO: 53 - protein, 58 aa, Homo sapiens
CPCPYIDASRRFSDTCFLDTDGQATCDACAPGYTGRRCESCAPGYEGNPIQPGGKCRP

SEQ ID NO: 54 - protein, 45 aa, Homo sapiens
CDERGSMGTSGEACRCKNNVVGRLCNECADGSFHLSTRNPDGCLK

SEQ ID NO: 55 - protein, 50 aa, Homo sapiens
CSCHGHSEACEPETGACQGCQHHTEGPRCEQCQPGYYGDAQRGTPQDCQL

SEQ ID NO: 56 - protein, 57 aa, Homo sapiens
CPCYGDPAAGQAAHTCFLDTDGHPTCDACSPGHSGRHCERCAPGYYGNPSQGQPCQR

SEQ ID NO: 57 - protein, 50 aa, Homo sapiens
CNCDPQGSVSSQCDAAGQCQCKAQVEGLTCSHCRPHHFHLSASNPDGCLP

SEQ ID NO: 58 - protein, 36 aa, Homo sapiens
PCALGEGPACAHCAPDNSTRCGSCNPGYVLAQGLCR

SEQ ID NO: 59 - protein, 36 aa, Homo sapiens
PCTVGDASACLTCAPDNRTRCGTCNTGYMLSQGLCK

SEQ ID NO: 60 - protein, 42 aa, Homo sapiens
EVDECSRPNRGGCEQRCLNTLGSYKCSCDPGYELAPDKRRCE

SEQ ID NO: 61 - protein, 40 aa, Homo sapiens
KDECSKDNGGCQQDCVNTFGSYECQCRSGFVLHDNKHDCK

SEQ ID NO: 62 - protein, 37 aa, Homo sapiens
ASGDCVPSPCHNGGTCLEEEEGVRCLCLPGYGGDLCD

SEQ ID NO: 63 - protein, 39 aa, Homo sapiens
GCNFNNGGCHQDCFEGGDGSFLCGCRPGFRLLDDLVTCA

SEQ ID NO: 64 - protein, 40 aa, Homo sapiens
PCSSSPCRGGATCALGPHGKNYTCRCPQGYQLDSSQLDCV

SEQ ID NO: 65 - protein, 38 aa, Homo sapiens
LCGPEGDGYCLHGDCIHARDIDGMYCRCSHGYTGIRCQ

SEQ ID NO: 66 - protein, 59 aa, Homo sapiens
DDNICLREPCENYMKCVSVLRFDSSAPFLSSTTVLFRPIHPINGLRCRCPPGFTGDYCE

SEQ ID NO: 67 - protein, 37 aa, Homo sapiens
EIDLCYSDPCGANGRCRSREGGYTCECFEDFTGEHCE

SEQ ID NO: 68 - protein, 39 aa, Homo sapiens
RSGRCANGVCKNGGTCVNLLIGGFHCVCPPGEYERPYCE

SEQ ID NO: 69 - protein, 37 aa, Homo sapiens
RRNFCDGRRCQNGGTCVNRWNMYLCECPLRFGGKNCE

SEQ ID NO: 70 - protein, 36 aa, Homo sapiens
VDDPCTSSPCPPNSRCHDAWEDYSCVCDKGYLGINC

SEQ ID NO: 71 - protein, 39 aa, Homo sapiens
VDACHLNPCENMGACVRSPGSPQGYVCECGPSHYGPYCE

SEQ ID NO: 72 - protein, 33 aa, Homo sapiens
NKLDLPCPRGWWGNPVCGPCHCAVSKGFDPDCN

SEQ ID NO: 73 - protein, 36 aa, Homo sapiens
TNGQCQCKENYYKLLAQDTCLPCDCFPHGSHSRTCD

SEQ ID NO: 74 - protein, 48 aa, Homo sapiens
CDCFPHGSHSRTCDMATGQCACKPGVIGRQCNRCDNPFAEVTTLGCEV

SEQ ID NO: 75 - protein, 59 aa, Homo sapiens
DDNICLREPCENYMRCVSVLRFDSSAPFIASSSVLFRPIHPVGGLRCRCPPGFTGDYCE

SEQ ID NO: 76 - protein, 37 aa, Homo sapiens
EVDLCYSRPCGPHGRCRSREGGYTCLCRDGYTGEHCE

SEQ ID NO: 77 - protein, 39 aa, Homo sapiens
RSGRCTPGVCKNGGTCVNLLVGGFKCDCPSGDFEKPYCQ

SEQ ID NO: 78 - protein, 37 aa, Homo sapiens
KKNVCDSNTCHNGGTCVNQWDAFSCECPLGFGGKSCA

SEQ ID NO: 79 - protein, 36 aa, Homo sapiens
LPDPCDSNPCPANSYCSNDWDSYSCSCDPGYYGDNC

SEQ ID NO: 80 - protein, 39 aa, Homo sapiens
TNVCDLNPCEHQSVCTRKPSAPHGYTCECPPNYLGPYCE

SEQ ID NO: 81 - protein, 40 aa, Homo sapiens
TCGPCNCDVSKGFDPDCNKTSGECHCKENHYRPPGSPTCL

SEQ ID NO: 82 - protein, 48 aa, Homo sapiens
CDCYPTGSLSRVCDPEDGQCPCKPGVIGRQCDRCDNPFAEVTTNGCEV

SEQ ID NO: 83 - protein, 59 aa, Homo sapiens
DDNVCLREPCENYMKCVSVLRFDSSAPFLASASTLFRPIQPIAGLRCRCPPGFTGDFCE

SEQ ID NO: 84 - protein, 40 aa, Homo sapiens
EAGRCVPGVCRNGGTCTDAPNGGFRCQCPAGGAFEGPRCE

SEQ ID NO: 85 - protein, 37 aa, Homo sapiens
KLHFCDSGPCKNSGFCSERWGSFSCDCPVGFGGKDCQ

SEQ ID NO: 86 - protein, 37 aa, Homo sapiens
VTNACASGPCPPHADCRDLWQTFSCTCQPGYYGPGCV

SEQ ID NO: 87 - protein, 38 aa, Homo sapiens
DACLLNPCQNQGSCRHLPGAPHGYTCDCVGGYFGHHCE

SEQ ID NO: 88 - protein, 33 aa, Homo sapiens
HRMDQQCPRGWWGSPTCGPCNCDVHKGFDPNCN

SEQ ID NO: 89 - protein, 36 aa, Homo sapiens
TNGQCHCKEFHYRPRGSDSCLPCDCYPVGSTSRSCA

SEQ ID NO: 90 - protein, 48 aa, Homo sapiens
CDCYPVGSTSRSCAPHSGQCPCRPGALGRQCNSCDSPFAEVTASGCRV

SEQ ID NO: 91 - protein, 47 aa, Homo sapiens
DTNECIQFPFVCPRDKPVCVNTYGSYRCRTNKKCSRGYEPNEDGTAC

SEQ ID NO: 92 - protein, 41 aa, Homo sapiens
VSDLCATGDHDCEQVCISSPGSYTCACHEGFTLNSDGKTCN

SEQ ID NO: 93 - protein, 40 aa, Homo sapiens
PLLHCAPGFCFPGVACIQTESGARCGPCPAGFTGNGSHCT

SEQ ID NO: 94 - protein, 53 aa, Homo sapiens
DVNECNAHPCFPRVRCINTSPGFRCEACPPGYSGPTHQGVGLAFAKANKQVCT

SEQ ID NO: 95 - protein, 43 aa, Homo sapiens
DINECETGQHNCVPNSVCINTRGSFQCGPCQPGFVGDQASGCQ

SEQ ID NO: 96 - protein, 43 aa, Homo sapiens
AQRFCPDGSPSECHEHADCVLERDGSRSCVCAVGWAGNGILCG

SEQ ID NO: 97 - protein, 42 aa, Homo sapiens
DSRGCARWCPQNSSCVNATACRCNPGFSSFSEIITTPTETCD

SEQ ID NO: 98 - protein, 52 aa, Homo sapiens
DINECATPSKVSCGKFSDCWNTEGSYDCVCSPGYEPVSGAKTFKNESENTCQ

SEQ ID NO: 99 - protein, 44 aa, Homo sapiens
DVDECQQNPRLCKSYGTCVNTLGSYTCQCLPGFKFIPEDPKVCT

SEQ ID NO: 100 - protein, 49 aa, Homo sapiens
DVNECTSGQNPCHSSTHCLNNVGSYQCRCRPGWQPIPGSPNGPNNTVCE

SEQ ID NO: 101 - protein, 49 aa, Homo sapiens
DVDECSSGQHQCDSSTVCFNTVGSYSCRCRPGWKPRHGIPNNQKDTVCE

SEQ ID NO: 102 - protein, 35 aa, Homo sapiens
DRCLPNYCEHGGECSQSWSTFHCNCTNTGYRGATC

SEQ ID NO: 103 - protein, 35 aa, Homo sapiens
CSSYGKLCRNGGKCRERPIGFFCDCTFSAYTGPFC

SEQ ID NO: 104 - protein, 35 aa, Homo sapiens
DRCKMNPCLNGGTCYPTETSYVCTCVPGYSGDQCE

SEQ ID NO: 105 - protein, 37 aa, Homo sapiens
DFDECHSNPCRNGATCVDGFNTFRCLCLPSYVGALCE

SEQ ID NO: 106 - protein, 43 aa, Homo sapiens
RSVCDLFPSYCHNGGQCYLVENIGAFCRCNTQDYIWHKGMRCE

SEQ ID NO: 107 - protein, 35 aa, Homo sapiens
DRCLPSYCEHGGECSQSWDTFSCDCLGTGYTGETC

SEQ ID NO: 108 - protein, 38 aa, Homo sapiens
VKDHCSKHSPCQKGGTCVNMPSGPHCLCPQHLTGNHCQ

SEQ ID NO: 109 - protein, 37 aa, Homo sapiens
ASQACRTNPCLHGGRCLEVEGHRLCHCPVGYTGAFCD

SEQ ID NO: 110 - protein, 42 aa, Homo sapiens
DIDECASSNGTLCAHICINTLGSYRCECREGYIREDDGKTCT

SEQ ID NO: 111 - protein, 49 aa, Homo sapiens
DLDECASRSKSGEEDPQPQCQHLCHNYVGGYFCSCRPGYELQEDTHSCQ

SEQ ID NO: 112 - protein, 42 aa, Homo sapiens
DINECTDFVDVPCSHFCNNFIGGYFCSCPPEYFLHDDMKNCG

SEQ ID NO: 113 - protein, 49 aa, Homo sapiens
DLDECASRSKSGEEDPQPQCQHLCHNYVGGYFCSCRPGYELQEDRHSCQ

SEQ ID NO: 114 - protein, 42 aa, Homo sapiens
PKYGCNFNNGGCHQDCFEGGDGSFLCGCRPGFRLLDDLVTCA

SEQ ID NO: 115 - protein, 43 aa, Homo sapiens
SRNPCSSSPCRGGATCVLGPHGKNYTCRCPQGYQLDSSQLDCV

SEQ ID NO: 116 - protein, 40 aa, Homo sapiens
DVDECQDSPCAQECVNTPGGFRCECWVGYEPGGPGEGACQ

SEQ ID NO: 117 - protein, 42 aa, Homo sapiens
DVDECALGRSPCAQGCTNTDGSFHCSCEEGYVLAGEDGTQCQ

SEQ ID NO: 118 - protein, 42 aa, Homo sapiens
DVDECVGPGGPLCDSLCFNTQGSFHCGCLPGWVLAPNGVSCT

SEQ ID NO: 119 - protein, 31 aa, Homo sapiens
CAPCPNNGRPTLSGTECLCVCQSGTYGENCE

SEQ ID NO: 120 - protein, 31 aa, Homo sapiens
CRPCQNGGLATVEGTHCLCHCKPYTFGAACE

SEQ ID NO: 121 - protein, 31 aa, Homo sapiens
CGPCFNNGVPILEGTSCRCQCRLGSLGAACE

SEQ ID NO: 122 - protein, 31 aa, Homo sapiens
CAPCQGNGVPVLKGSRCDCICPVGSQGLACE

SEQ ID NO: 123 - protein, 31 aa, Homo sapiens
CHTCQNGGTVILMDGKCLCACPFKFEGIACE

SEQ ID NO: 124 - protein, 38 aa, Homo sapiens
ITDRCSPNMCEHDGRCYQSWDDFICYCELTGYKGETCH

SEQ ID NO: 125 - protein, 40 aa, Homo sapiens
CTGHCAHPRLPCFHGGRCVERYSYYTCDCDLTAFDGPYCN

SEQ ID NO: 126 - protein, 38 aa, Homo sapiens
IIDRCVPNHCEHGGKCSQTWDSFKCTCDETGYSGATCH

SEQ ID NO: 127 - protein, 40 aa, Homo sapiens
CSGHCTSYGTNCENGGKCLERYHGYSCDCSNTAYDGTFCN

SEQ ID NO: 128 - protein, 33 aa, Homo sapiens
CLPSYCEHGGECSQSWDTFSCDCLGTGYTGETC

SEQ ID NO: 129 - protein, 35 aa, Homo sapiens
CSTYGHLCRNGGRCREKRRGVTCDCAFSAYDGPFC

SEQ ID NO: 130 - protein, 38 aa, Homo sapiens
ITDRCLPSYCEHGGECSQSWDTFSCDCLGTGYTGETCH

SEQ ID NO: 131 - protein, 39 aa, Homo sapiens
AGHCSTYGHLCRNGGRCREKRRGVTCDCAFSAYDGPFCS

SEQ ID NO: 132 - protein, 38 aa, Homo sapiens
ISDRCLPNYCEHGGECSQSWSTFHCNCTNTGYRGATCH

SEQ ID NO: 133 - protein, 40 aa, Homo sapiens
CRGHCSSYGKLCRNGGKCRERPIGFFCDCTFSAYTGPFCS

SEQ ID NO: 134 - protein, 38 aa, Homo sapiens
IKDRCLPNYCEHGGSCSQSWTTFYCNCSDTSYTGATCH

SEQ ID NO: 135 - protein, 39 aa, Homo sapiens
PGHCSSYGSICHNGGKCVEKHNGYLCDCTNSPYEGPFCK

SEQ ID NO: 136 - protein, 41 aa, Homo sapiens
AIRLCGPEGDGYCLHGDCIHARDIDGMYCRCYHGYIGIRCQ

SEQ ID NO: 137 - protein, 32 aa, Homo sapiens
NPCQGSATCVNTPGERSFLCKCPPGYSGTICE

SEQ ID NO: 138 - protein, 29 aa, Homo sapiens
PCHNNATCEDSVDNYTCHCWPGYTGAQCE

SEQ ID NO: 139 - protein, 25 aa, Homo sapiens
CRNGGTCVLGSFCVCPAHFTGRYCE

SEQ ID NO: 140 - protein, 30 aa, Homo sapiens
ARPRCCRNGGTCVLGSFCVCPAHFTGRYCE

SEQ ID NO: 141 - protein, 35 aa, Homo sapiens
DPCENNPCLHGGTCNANGTMYGCSCDQGFAGENCE

SEQ ID NO: 142 - protein, 43 aa, Homo sapiens
PCPGRYLRAGKCAELPNCLDDLGGFACECATGFELGKDGRSCV

SEQ ID NO: 143 - protein, 34 aa, Homo sapiens
PRNPCRMSCQNHGRLNISTCHCHCPPGYTGRYCQ

SEQ ID NO: 144 - protein, 37 aa, Homo sapiens
DKKVCSSNPCQNGGTCLNLHDSFFCICPPQWKGPLCS

SEQ ID NO: 145 - protein, 42 aa, Homo sapiens
DVNECEIYSGTPLSCQNGGTCVNTMGSYSCHCPPETYGPQCA

SEQ ID NO: 146 - protein, 42 aa, Homo sapiens
DRDECSFQPGPCSTLVQCFNTQGSFYCGACPTGWQGNGYICE

SEQ ID NO: 147 - protein, 44 aa, Homo sapiens
DINECEINNGGCSVAPPVECVNTPGSSHCQACPPGYQGDGRVCT

SEQ ID NO: 148 - protein, 37 aa, Homo sapiens
LTDICSVSNGGCHPDASCSSTLGSLPLCTCLPGYTGN

SEQ ID NO: 149 - protein, 36 aa, Homo sapiens
LSNICLSHPCLNGQCIDTVSGYFCKCDSGWTGVNCT

SEQ ID NO: 150 - protein, 37 aa, Homo sapiens
NINECLSNPCLNGGTCVDGVDSFSCECTRLWTGALCQ

SEQ ID NO: 151 - protein, 41 aa, Homo sapiens
GCKYLSDINITRYNINCRENRACNELFHCQCDPGYAPPDCE

SEQ ID NO: 152 - protein, 41 aa, Homo sapiens
LPCPGGTERPCGGYGQCEGEGTRGGSGHCDCQAGYGGEACG

SEQ ID NO: 153 - protein, 43 aa, Homo sapiens
DCLACQGGSQRPCSGNGHCSGDGSRQGDGSCRCHMGYQGPLCT

SEQ ID NO: 154 - protein, 42 aa, Homo sapiens
DVDECSLAEKTCVRKNENCYNTPGSYVCVCPDGFEETEDACV

SEQ ID NO: 155 - protein, 49 aa, Homo sapiens
APGPCAAQPCRNGGVCTSRPEPDPQHPAPAGEPGYSCTCPAGISGANCQ

SEQ ID NO: 156 - protein, 37 aa, Homo sapiens
DINECDSNPCHHGGSCLDQPNGYNCHCPHGWVGANCE

SEQ ID NO: 157 - protein, 40 aa, Homo sapiens
VADPCASNPCHHGNCSSSSSSSSDGYLCICNEGYEGPNCE

SEQ ID NO: 158 - protein, 40 aa, Homo sapiens
PGESHANDLECSGKGKCTTKPSEATFSCTCEEQYVGTFCE

SEQ ID NO: 159 - protein, 42 aa, Homo sapiens
EYDACQRKPCQNNASCIDANEKQDGSNFTCVCLPGYTGELCQ

SEQ ID NO: 160 - protein, 37 aa, Homo sapiens
KIDYCILDPCRNGATCISSLSGFTCQCPEGYFGSACE

SEQ ID NO: 161 - protein, 37 aa, Homo sapiens
KVDPCASSPCQNNGTCYVDGVHFTCNCSPGFTGPTCA

SEQ ID NO: 162 - protein, 36 aa, Homo sapiens
LIDFCALSPCAHGTCRSVGTSYKCLCDPGYHGLYCE

SEQ ID NO: 163 - protein, 37 aa, Homo sapiens
EYNECLSAPCLNAATCRDLVNGYECVCLAEYKGTHCE

SEQ ID NO: 164 - protein, 37 aa, Homo sapiens
YKDPCANVSCLNGATCDSDGLNGTCICAPGFTGEECD

SEQ ID NO: 165 - protein, 38 aa, Homo sapiens
DVRACSSAPCANNGTCVSLDDGLYECSCAPGYSGKDCQ

SEQ ID NO: 166 - protein, 35 aa, Homo sapiens
NGSPCQHGGTCVDDEGRASHASCLCPPGFSGNFCE

SEQ ID NO: 167 - protein, 31 aa, Homo sapiens
TPNPCENDGVCTDIGGDFRCRCPAGFIDKTC

SEQ ID NO: 168 - protein, 29 aa, Homo sapiens
CLPGCDEQHGFCDKPGECKCRVGWQGRYC

SEQ ID NO: 169 - protein, 29 aa, Homo sapiens
CIRYPGCLHGTCQQPWQCNCQEGWGGLFC

SEQ ID NO: 170 - protein, 34 aa, Homo sapiens
CTHHKPCKNGATCTNTGQGSYTCSCRPGYTGATC

SEQ ID NO: 171 - protein, 32 aa, Homo sapiens
CDPSPCKNGGSCTDLENSYSCTCPPGFYGKIC

SEQ ID NO: 172 - protein, 33 aa, Homo sapiens
CADGPCFNGGRCSDSPDGGYSCRCPVGYSGFNC

SEQ ID NO: 173 - protein, 32 aa, Homo sapiens
CSSSPCSNGAKCVDLGDAYLCRCQAGFSGRHC

SEQ ID NO: 174 - protein, 32 aa, Homo sapiens
CASSPCANGGTCRDGVNDFSCTCPPGYTGRNC

SEQ ID NO: 175 - protein, 32 aa, Homo sapiens
CEHAPCHNGATCHERGHRYVCECARGYGGPNC

SEQ ID NO: 176 - protein, 34 aa, Homo sapiens
APLVCRAGCSPEHGFCEQPGECRCLEGWTGPLCT

SEQ ID NO: 177 - protein, 37 aa, Homo sapiens
GPGPCDGNPCANGGSCSETPRSFECTCPRGFYGLRCE

SEQ ID NO: 178 - protein, 40 aa, Homo sapiens
SGVTCADGPCFNGGLCVGGADPDSAYICHCPPGFQGSNCE

SEQ ID NO: 179 - protein, 37 aa, Homo sapiens
RVDRCSLQPCRNGGLCLDLGHALRCRCRAGFAGPRCE

SEQ ID NO: 180 - protein, 37 aa, Homo sapiens
DLDDCAGRACANGGTCVEGGGAHRCSCALGFGGRDCR

SEQ ID NO: 181 - protein, 37 aa, Homo sapiens
RADPCAARPCAHGGRCYAHFSGLVCACAPGYMGARCE

SEQ ID NO: 182 - protein, 34 aa, Homo sapiens
QQPICLSGCHEQNGYCSKPAECLCRPGWQGRLCN

SEQ ID NO: 183 - protein, 31 aa, Homo sapiens
ECIPHNGCRHGTCSTPWQCTCDEGWGGLFCD

SEQ ID NO: 184 - protein, 39 aa, Homo sapiens
DLNYCTHHSPCKNGATCSNSGQRSYTCTCRPGYTGVDCE

SEQ ID NO: 185 - protein, 37 aa, Homo sapiens
ELSECDSNPCRNGGSCKDQEDGYHCLCPPGYYGLHCE

SEQ ID NO: 186 - protein, 39 aa, Homo sapiens
STLSCADSPCFNGGSCRERNQGANYACECPPNFTGSNCE

SEQ ID NO: 187 - protein, 37 aa, Homo sapiens
KVDRCTSNPCANGGQCLNRGPSRMCRCRPGFTGTYCE

SEQ ID NO: 188 - protein, 37 aa, Homo sapiens
HVSDCARNPCAHGGTCHDLENGLMCTCPAGFSGRRCE

SEQ ID NO: 189 - protein, 39 aa, Homo sapiens
SIDACASSPCFNRATCYTDLSTDTFVCNCPYGFVGSRCE

SEQ ID NO: 190 - protein, 33 aa, Homo sapiens
ECPLNYCRNGGTCVVEKNGPMCRCRQGWKGNRC

SEQ ID NO: 191 - protein, 38 aa, Homo sapiens
PCLRKYKDFCIHGECKYVKELRAPSCICHPGYHGERCH

SEQ ID NO: 192 - protein, 33 aa, Homo sapiens
CPGSGERRICSHHGVCSNEGKCICQPDWTGKDC

SEQ ID NO: 193 - protein, 33 aa, Homo sapiens
GVHECAMQCHGRGVCNNRKNCHCEAHWAPPFCD

SEQ ID NO: 194 - protein, 29 aa, Homo sapiens
CRSKCHGHGVCDSNRHCYCEEGWAPPDCT

SEQ ID NO: 195 - protein, 35 aa, Homo sapiens
MGYNCNATTKCKGKGICNNFGNCQCFPGHRPPDCK

SEQ ID NO: 196 - protein, 33 aa, Homo sapiens
ETEGCGKKCNGHGVCNNNQNCHCLPGWAPPFCN

SEQ ID NO: 197 - protein, 34 aa, Homo sapiens
LGYDCTTDKCNDRGVCNNKKHCHCSASYLPPDCS

SEQ ID NO: 198 - protein, 29 aa, Homo sapiens
CQPKTCNMRGICNNKQHCHCNHEWAPPYC

SEQ ID NO: 199 - protein, 30 aa, Homo sapiens
CLPETCNMKGICNNKHHCHCGYGWSPPYCQ

SEQ ID NO: 200 - protein, 38 aa, Homo sapiens
NFSTCLSSKEGTICSGNGVCSNELKCVCNRHWIGSDCN

SEQ ID NO: 201 - protein, 38 aa, Homo sapiens
NMSSCPLDSKGKVCSGHGVCSNEATCICDFTWAGTDCS

SEQ ID NO: 202 - protein, 33 aa, Homo sapiens
KSTNCSSKCKGHAVCDHELQCQCEEGWIPPDCD

SEQ ID NO: 203 - protein, 30 aa, Homo sapiens
CSPAFCNKRGICNNKHHCHCNYLWDPPNCL

SEQ ID NO: 204 - protein, 35 aa, Homo sapiens
LQFDCLPEKCNTRGVCNNRKNCHCMYGWAPPFCEE

SEQ ID NO: 205 - protein, 33 aa, Homo sapiens
SAHVCSQQCSGHGVCDSRNKCHCSPGYKPPNCQ

SEQ ID NO: 206 - protein, 33 aa, Homo sapiens
ELQRCLTACHSHGVCNSNHNCHCAPGWAPPFCD

SEQ ID NO: 207 - protein, 33 aa, Homo sapiens
RSSNCSAQCHNHGVCNHKQECHCHAGWAPPHCA

SEQ ID NO: 208 - protein, 55 aa, Homo sapiens
CDVQKKCHGHGVCNSNKNCHCENGWAPPNCETKGYGGSVDSGPTYNEMNTALRDG

SEQ ID NO: 209 - protein, 34 aa, Homo sapiens
DVDECAQALHDCRPSQDCHNLPGSYQCTCPDGYR

SEQ ID NO: 210 - protein, 31 aa, Homo sapiens
DIDECRYRYCQHRCVNLPGSFRCQCEPGFQL

SEQ ID NO: 211 - protein, 32 aa, Homo sapiens
DIDECSYSSYLCQYRCVNEPGRFSCHCPQGYQ

SEQ ID NO: 212 - protein, 28 aa, Homo sapiens
DIDECESGAHQCSEAQTCVNFHGGYRCV

SEQ ID NO: 213 - protein, 38 aa, Homo sapiens
QNCTKTPCLPNAKCEIRNGIEACYCNMGFSGNGVTICE

SEQ ID NO: 214 - protein, 51 aa, Homo sapiens
DDNECGNLTQSCGENANCTNTEGSYYCMCVPGFRSSSNQDRFITNDGTVCI

SEQ ID NO: 215 - protein, 46 aa, Homo sapiens
YTQCTDGYEWDPVRQQCKDIDECDIVPDACKGGMKCVNHYGGYLCL

SEQ ID NO: 216 - protein, 41 aa, Homo sapiens
DIDECTAGTHNCRADQVCINLRGSFACQCPPGYQKRGEQCV

SEQ ID NO: 217 - protein, 40 aa, Homo sapiens
DIDECTIPPYCHQRCVNTPGSFYCQCSPGFQLAANNYTCV

SEQ ID NO: 218 - protein, 40 aa, Homo sapiens
DINECDASNQCAQQCYNILGSFICQCNQGYELSSDRLNCE

SEQ ID NO: 219 - protein, 40 aa, Homo sapiens
DIDECRTSSYLCQYQCVNEPGKFSCMCPQGYQVVRSRTCQ

SEQ ID NO: 220 - protein, 45 aa, Homo sapiens
DINECETTNECREDEMCWNYHGGFRCYPRNPCQDPYILTPENRCV

SEQ ID NO: 221 - protein, 46 aa, Homo sapiens
YTECTDGYEWDPDSQHCRDVNECLTIPEACKGEMKCINHYGGYLCL

SEQ ID NO: 222 - protein, 41 aa, Homo sapiens
DVDECAQALHDCRPSQDCHNLPGSYQCTCPDGYRKIGPECV

SEQ ID NO: 223 - protein, 39 aa, Homo sapiens
DIDECRYRYCQHRCVNLPGSFRCQCEPGFQLGPNNRSCV

SEQ ID NO: 224 - protein, 40 aa, Homo sapiens
DVNECDMGAPCEQRCFNSYGTFLCRCHQGYELHRDGFSCS

SEQ ID NO: 225 - protein, 40 aa, Homo sapiens
DIDECSYSSYLCQYRCINEPGRFSCHCPQGYQLLATRLCQ

SEQ ID NO: 226 - protein, 46 aa, Homo sapiens
DIDECESGAHQCSEAQTCVNFHGGYRCVDTNRCVEPYIQVSENRCL

SEQ ID NO: 227 - protein, 49 aa, Homo sapiens
KGNNCRDSTLCPAYATCTNTVDSYYCACKQGFLSSNGQNHFKDPGVRCK

SEQ ID NO: 228 - protein, 52 aa, Homo sapiens
DIDECSQSPQPCGPNSSCKNLSGRYKCSCLDGFSSPTGNDWVPGKPGNFSCT

SEQ ID NO: 229 - protein, 40 aa, Homo sapiens
DINECLTSSVCPEHSDCVNSMGSYSCSCQVGFISRNSTCE

SEQ ID NO: 230 - protein, 49 aa, Homo sapiens
DVDECADPRACPEHATCNNTVGNYSCFCNPGFESSSGHLSFQGLKASCE

SEQ ID NO: 231 - protein, 47 aa, Homo sapiens
DIDECTEMCPINSTCTNTPGSYFCTCHPGFAPSNGQLNFTDQGVECR

SEQ ID NO: 232 - protein, 49 aa, Homo sapiens
DIDECRQDPSTCGPNSICTNALGSYSCGCIAGFHPNPEGSQKDGNFSCQ

SEQ ID NO: 233 - protein, 42 aa, Homo sapiens
DSRGCARWCPQDSSCVNATACRCNPGFSSFSEIITTPMETCD

SEQ ID NO: 234 - protein, 52 aa, Homo sapiens
DINECATLSKVSCGKFSDCWNTEGSYDCVCSPGYEPVSGAKTFKNESENTCQ

SEQ ID NO: 235 - protein, 44 aa, Homo sapiens
DVDECQQNPRLCKSYGTCVNTLGSYTCQCLPGFKLKPEDPKLCT

SEQ ID NO: 236 - protein, 43 aa, Homo sapiens
TKTSCAKCPPNASCVNNTHCTCNHGYTSGSGQKLFTFPLETCN

SEQ ID NO: 237 - protein, 52 aa, Homo sapiens
DINECTPPYSVYCGFNAVCYNVEGSFYCQCVPGYRLHSGNEQFSNSNENTCQ

SEQ ID NO: 238 - protein, 37 aa, Homo sapiens
DICDPNPCENGGICLPGLADGSFSCECPDGFTDPNCS

SEQ ID NO: 239 - protein, 44 aa, Homo sapiens
SAGPCTPNPCHNGGTCEISEAYRGDTFIGYVCKCPRGFNGIHCQ

SEQ ID NO: 240 - protein, 37 aa, Homo sapiens
NINECEVEPCKNGGICTDLVANYSCECPGEFMGRNCQ

SEQ ID NO: 241 - protein, 40 aa, Homo sapiens
DTDECQIAGVCQQMCVNYVGGFECYCSEGHELEADGISCS

SEQ ID NO: 242 - protein, 27 aa, Homo sapiens
CEPGCKFGECVGPNKCRCFPGYTGKTC

SEQ ID NO: 243 - protein, 40 aa, Homo sapiens
DVNECGMKPRPCQHRCVNTHGSYKCFCLSGHMLMPDATCV

SEQ ID NO: 244 - protein, 37 aa, Homo sapiens
TCAMINCQYSCEDTEEGPQCLCPSSGLRLAPNGRDCL

SEQ ID NO: 245 - protein, 39 aa, Homo sapiens
DIDECASGKVICPYNRRCVNTFGSYYCKCHIGFELQYIS

SEQ ID NO: 246 - protein, 41 aa, Homo sapiens
DINECTMDSHTCSHHANCFNTQGSFKCKCKQGYKGNGLRCS

SEQ ID NO: 247 - protein, 33 aa, Homo sapiens
GAAICQPPCRNGGSCVQPGRCRCPAGWRGDTCQ

SEQ ID NO: 248 - protein, 41 aa, Homo sapiens
DVDECSARRGGCPQRCVNTAGSYWCQCWEGHSLSADGTLCV

SEQ ID NO: 249 - protein, 32 aa, Homo sapiens
EAICAKPCLNGGVCVRPDQCECAPGWGGKHCH

SEQ ID NO: 250 - protein, 41 aa, Homo sapiens
DVDECRTSITLCSHHCFNTAGSFTCGCPHDLVLGVDGRTCM

SEQ ID NO: 251 - protein, 41 aa, Homo sapiens
FSHLCLEDHNSYCINGACAFHHELEKAICRCFTGYTGERCE

SEQ ID NO: 252 - protein, 36 aa, Homo sapiens
TAACTNTSCSGHGECVETINNYTCKCDPGFSGLKCE

SEQ ID NO: 253 - protein, 36 aa, Homo sapiens
DYCSQNTCLNGGKCSWTHGAGYVCKCPPQFSGKHCE

SEQ ID NO: 254 - protein, 29 aa, Homo sapiens
PCLEGGTCILSPKGASCNCPHPYTGDRCE

SEQ ID NO: 255 - protein, 35 aa, Homo sapiens
DVDECVGLQPVCPQGTTCINTGGSFQCVSPECPEG

SEQ ID NO: 256 - protein, 29 aa, Homo sapiens
CHLHARCVSQEGVARCRCLDGFEGDGFSC

SEQ ID NO: 257 - protein, 38 aa, Homo sapiens
CTDGHRGGCSEHANCLSTGLNTRRCECHAGYVGDGLQC

SEQ ID NO: 258 - protein, 38 aa, Homo sapiens
CSHPDRGGCSENAECVPGSLGTHHCTCHKGWSGDGRVC

SEQ ID NO: 259 - protein, 32 aa, Homo sapiens
GGCHTDALCSYVGPGQSRCTCKLGFAGDGYQC

SEQ ID NO: 260 - protein, 37 aa, Homo sapiens
CRAGNGGCHGLATCRAVGGGQRVCTCPPGFGGDGFSC

SEQ ID NO: 261 - protein, 37 aa, Homo sapiens
CAHGHGGCSPHANCTKVAPGQRTCTCQDGYMGDGELC

SEQ ID NO: 262 - protein, 38 aa, Homo sapiens
CLIHHGGCHIHAECIPTGPQQVSCSCREGYSGDGIRTC

SEQ ID NO: 263 - protein, 38 aa, Homo sapiens
CSKNNGGCSPYATCKSTGDGQRTCTCDTAHTVGDGLTC

SEQ ID NO: 264 - protein, 30 aa, Homo sapiens
SGQCLCRSGFAGTACELCAPGAFGPHCQAC

SEQ ID NO: 265 - protein, 36 aa, Homo sapiens
CQDGHGGCSEHANCSQVGTMVTCTCLPDYEGDGWSC

SEQ ID NO: 266 - protein, 33 aa, Homo sapiens
DIDECEVFPGVCKNGLCVNTRGSFKCQCPSGMT

SEQ ID NO: 267 - protein, 32 aa, Homo sapiens
DINECKMIPSLCTHGKCRNTIGSFKCRCDSGF

SEQ ID NO: 268 - protein, 24 aa, Homo sapiens
SFKCRCDSGFALDSEERNCTDIDE

SEQ ID NO: 269 - protein, 35 aa, Homo sapiens
DIDECRISPDLCGRGQCVNTPGDFECKCDEGYESG

SEQ ID NO: 270 - protein, 34 aa, Homo sapiens
DIDECQRDPLLCRGGVCHNTEGSYRCECPPGHQL

SEQ ID NO: 271 - protein, 34 aa, Homo sapiens
DINECELSAHLCPNGRCVNLIGKYQCACNPGYHS

SEQ ID NO: 272 - protein, 41 aa, Homo sapiens
DIDECEDNPNICDGGQCTNIPGEYRCLCYDGFMASEDMKTC

SEQ ID NO: 273 - protein, 33 aa, Homo sapiens
DVNECDLNPNICLSGTCENTKGSFICHCDMGYS

SEQ ID NO: 274 - protein, 32 aa, Homo sapiens
IVPICRHSCGDGFCSRPNMCTCPSGQIAPSCG

SEQ ID NO: 275 - protein, 41 aa, Homo sapiens
DINECETPGICMNGRCVNTDGSYRCECFPGLAVGLDGRVCV

SEQ ID NO: 276 - protein, 42 aa, Homo sapiens
DINECALDPDICPNGICENLRGTYKCICNSGYEVDSTGKNCV

SEQ ID NO: 277 - protein, 42 aa, Homo sapiens
DINECVLNSLLCDNGQCRNTPGSFVCTCPKGFIYKPDLKTCE

SEQ ID NO: 278 - protein, 40 aa, Homo sapiens
DIDECESSPCINGVCKNSPGSFICECSSESTLDPTKTICI

SEQ ID NO: 279 - protein, 42 aa, Homo sapiens
DIDECEVFPGVCKNGLCVNTRGSFKCQCPSGMTLDATGRICL

SEQ ID NO: 280 - protein, 42 aa, Homo sapiens
DINECKMIPSLCTHGKCRNTIGSFKCRCDSGFALDSEERNCT

SEQ ID NO: 281 - protein, 43 aa, Homo sapiens
DIDECRISPDLCGRGQCVNTPGDFECKCDEGYESGFMMMKNCM

SEQ ID NO: 282 - protein, 42 aa, Homo sapiens
DIDECQRDPLLCRGGVCHNTEGSYRCECPPGHQLSPNISACI

SEQ ID NO: 283 - protein, 42 aa, Homo sapiens
DINECELSAHLCPNGRCVNLIGKYQCACNPGYHSTPDRLFCV

SEQ ID NO: 284 - protein, 41 aa, Homo sapiens
DIDECSIMNGGCETFCTNSEGSYECSCQPGFALMPDQRSCT

SEQ ID NO: 285 - protein, 32 aa, Homo sapiens
SIQHCNIRCMNGGSCSDDHCLCQKGYIGTHCG

SEQ ID NO: 286 - protein, 42 aa, Homo sapiens
DIDECEDNPNICDGGQCTNIPGEYRCLCYDGFMASEDMKTCV

SEQ ID NO: 287 - protein, 42 aa, Homo sapiens
DVNECDLNPNICLSGTCENTKGSFICHCDMGYSGKKGKTGCT

SEQ ID NO: 288 - protein, 41 aa, Homo sapiens
DINECEIGAHNCGKHAVCTNTAGSFKCSCSPGWIGDGIKCT

SEQ ID NO: 289 - protein, 41 aa, Homo sapiens
DLDECSNGTHMCSQHADCKNTMGSYRCLCKEGYTGDGFTCT

SEQ ID NO: 290 - protein, 42 aa, Homo sapiens
DLDECSENLNLCGNGQCLNAPGGYRCECDMGFVPSADGKACE

SEQ ID NO: 291 - protein, 41 aa, Homo sapiens
DIDECSLPNICVFGTCHNLPGLFRCECEIGYELDRSGGNCT

SEQ ID NO: 292 - protein, 41 aa, Homo sapiens
DVNECLDPTTCISGNCVNTPGSYICDCPPDFELNPTRVGCV

SEQ ID NO: 293 - protein, 42 aa, Homo sapiens
DIDECQELPGLCQGGKCINTFGSFQCRCPTGYYLNEDTRVCD

SEQ ID NO: 294 - protein, 41 aa, Homo sapiens
DVNECETPGICGPGTCYNTVGNYTCICPPDYMQVNGGNNCM

SEQ ID NO: 295 - protein, 42 aa, Homo sapiens
DIDECREIPGVCENGVCINMVGSFRCECPVGFFYNDKLLVCE

SEQ ID NO: 296 - protein, 32 aa, Homo sapiens
QPVCESGCLNGGRCVAPNRCACTYGFTGPQCE

SEQ ID NO: 297 - protein, 41 aa, Homo sapiens
DIDECQNGPVCQRNAECINTAGSYRCDCKPGYRFTSTGQCN

SEQ ID NO: 298 - protein, 42 aa, Homo sapiens
DRNECQEIPNICSHGQCIDTVGSFYCLCHTGFKTNDDQTMCL

SEQ ID NO: 299 - protein, 39 aa, Homo sapiens
DINECERDACGNGTCRNTIGSFNCRCNHGFILSHNNDCI

SEQ ID NO: 300 - protein, 43 aa, Homo sapiens
DVDECASGNGNLCRNGQCINTVGSFQCQCNEGYEVAPDGRTCV

SEQ ID NO: 301 - protein, 40 aa, Homo sapiens
DINECLLEPRKCAPGTCQNLDGSYRCICPPGYSLQNEKCE

SEQ ID NO: 302 - protein, 42 aa, Homo sapiens
DIDECVEEPEICALGTCSNTEGSFKCLCPEGFSLSSSGRRCQ

SEQ ID NO: 303 - protein, 39 aa, Homo sapiens
DMDECKEPDVCKHGQCINTDGSYRCECPFGYILAGNECV

SEQ ID NO: 304 - protein, 40 aa, Homo sapiens
DTDECSVGNPCGNGTCKNVIGGFECTCEEGFEPGPMMTCE

SEQ ID NO: 305 - protein, 41 aa, Homo sapiens
DINECAQNPLLCAFRCVNTYGSYECKCPVGYVLREDRRMCK

SEQ ID NO: 306 - protein, 44 aa, Homo sapiens
DEDECEEGKHDCTEKQMECKNLIGTYMCICGPGYQRRPDGEGCV

SEQ ID NO: 307 - protein, 42 aa, Homo sapiens
DVDECQAIPGLCQGGNCINTVGSFECKCPAGHKLNEVSQKCE

SEQ ID NO: 308 - protein, 42 aa, Homo sapiens
DENECQTKPGICENGRCLNTRGSYTCECNDGFTASPNQDECL

SEQ ID NO: 309 - protein, 42 aa, Homo sapiens
DIDECKVIHDVCRNGECVNDRGSYHCICKTGYTPDITGTSCV

SEQ ID NO: 310 - protein, 41 aa, Homo sapiens
DLNECNQAPKPCNFICKNTEGSYQCSCPKGYILQEDGRSCK

SEQ ID NO: 311 - protein, 39 aa, Homo sapiens
DLDECATKQHNCQFLCVNTIGGFTCKCPPGFTQHHTSCI

SEQ ID NO: 312 - protein, 43 aa, Homo sapiens
DNNECTSDINLCGSKGICQNTPGSFTCECQRGFSLDQTGSSCE

SEQ ID NO: 313 - protein, 40 aa, Homo sapiens
DVDECEGNHRCQHGCQNIIGGYRCSCPQGYLQHYQWNQCV

SEQ ID NO: 314 - protein, 41 aa, Homo sapiens
DENECLSAHICGGASCHNTLGSYKCMCPAGFQYEQFSGGCQ

SEQ ID NO: 315 - protein, 40 aa, Homo sapiens
DINECGSAQAPCSYGCSNTEGGYLCGCPPGYFRIGQGHCV

SEQ ID NO: 316 - protein, 42 aa, Homo sapiens
DIDECSTIPGICEGGECTNTVSSYFCKCPPGFYTSPDGTRCI

SEQ ID NO: 317 - protein, 41 aa, Homo sapiens
VTDYCQLVRYLCQNGRCIPTPGSCRCECNKGFQLDLRGECI

SEQ ID NO: 318 - protein, 40 aa, Homo sapiens
DVDECEKNPCAGGECINNQGSYTCQCRAGYQSTLTRTECR

SEQ ID NO: 319 - protein, 42 aa, Homo sapiens
DIDECLQNGRICNNGRCINTDGSFHCVCNAGFHVTRDGKNCE

SEQ ID NO: 320 - protein, 41 aa, Homo sapiens
DMDECSIRNMCLNGMCINEDGSFKCICKPGFQLASDGRYCK

SEQ ID NO: 321 - protein, 32 aa, Homo sapiens
IVPICRNSCGDGFCSRPNMCTCSSGQISSTCG

SEQ ID NO: 322 - protein, 41 aa, Homo sapiens
DVDECQTPGICMNGHCINSEGSFRCDCPPGLAVGMDGRVCV

SEQ ID NO: 323 - protein, 42 aa, Homo sapiens
DINECALDPDICANGICENLRGSYRCNCNSGYEPDASGRNCI

SEQ ID NO: 324 - protein, 42 aa, Homo sapiens
DIDECLVNRLLCDNGLCRNTPGSYSCTCPPGYVFRTETETCE

SEQ ID NO: 325 - protein, 40 aa, Homo sapiens
DINECESNPCVNGACRNNLGSFNCECSPGSKLSSTGLICI

SEQ ID NO: 326 - protein, 42 aa, Homo sapiens
DVNECEVFPGVCPNGRCVNSKGSFHCECPEGLTLDGTGRVCL

SEQ ID NO: 327 - protein, 42 aa, Homo sapiens
DINECKAFPGMCTYGKCRNTIGSFKCRCNSGFALDMEERNCT

SEQ ID NO: 328 - protein, 43 aa, Homo sapiens
DIDECRISPDLCGSGICVNTPGSFECECFEGYESGFMMMKNCM

SEQ ID NO: 329 - protein, 42 aa, Homo sapiens
DIDECERNPLLCRGGTCVNTEGSFQCDCPLGHELSPSREDCV

SEQ ID NO: 330 - protein, 42 aa, Homo sapiens
DINECSLSDNLCRNGKCVNMIGTYQCSCNPGYQATPDRQGCT

SEQ ID NO: 331 - protein, 41 aa, Homo sapiens
DIDECMIMNGGCDTQCTNSEGSYECSCSEGYALMPDGRSCA

SEQ ID NO: 332 - protein, 32 aa, Homo sapiens
SIQQCSVRCMNGGTCADDHCQCQKGYIGTYCG

SEQ ID NO: 333 - protein, 42 aa, Homo sapiens
DIDECENNPDICDGGQCTNIPGEYRCLCYDGFMASMDMKTCI

SEQ ID NO: 334 - protein, 42 aa, Homo sapiens
DVNECDLNSNICMFGECENTKGSFICHCQLGYSVKKGTTGCT

SEQ ID NO: 335 - protein, 41 aa, Homo sapiens
DVDECEIGAHNCDMHASCLNIPGSFKCSCREGWIGNGIKCI

SEQ ID NO: 336 - protein, 41 aa, Homo sapiens
DLDECSNGTHQCSINAQCVNTPGSYRCACSEGFTGDGFTCS

SEQ ID NO: 337 - protein, 42 aa, Homo sapiens
DVDECAENINLCENGQCLNVPGAYRCECEMGFTPASDSRSCQ

SEQ ID NO: 338 - protein, 41 aa, Homo sapiens
DIDECSFQNICVFGTCNNLPGMFHCICDDGYELDRTGGNCT

SEQ ID NO: 339 - protein, 41 aa, Homo sapiens
DIDECADPINCVNGLCVNTPGRYECNCPPDFQLNPTGVGCV

SEQ ID NO: 340 - protein, 42 aa, Homo sapiens
DIDECQELPGLCQGGNCINTFGSFQCECPQGYYLSEDTRICE

SEQ ID NO: 341 - protein, 42 aa, Homo sapiens
DIDECFAHPGVCGPGTCYNTLGNYTCICPPEYMQVNGGHNCM

SEQ ID NO: 342 - protein, 42 aa, Homo sapiens
DIDECKEIPGICANGVCINQIGSFRCECPTGFSYNDLLLVCE

SEQ ID NO: 343 - protein, 33 aa, Homo sapiens
GQPVCENGCQNGGRCIGPNRCACVYGFTGPQCE

SEQ ID NO: 344 - protein, 42 aa, Homo sapiens
DIDECSNGDNLCQRNADCINSPGSYRCECAAGFKLSPNGACV

SEQ ID NO: 345 - protein, 42 aa, Homo sapiens
DRNECLEIPNVCSHGLCVDLQGSYQCICHNGFKASQDQTMCM

SEQ ID NO: 346 - protein, 39 aa, Homo sapiens
DVDECERHPCGNGTCKNTVGSYNCLCYPGFELTHNNDCL

SEQ ID NO: 347 - protein, 43 aa, Homo sapiens
DIDECSSFFGQVCRNGRCFNEIGSFKCLCNEGYELTPDGKNCI

SEQ ID NO: 348 - protein, 40 aa, Homo sapiens
DTNECVALPGSCSPGTCQNLEGSFRCICPPGYEVKSENCI

SEQ ID NO: 349 - protein, 42 aa, Homo sapiens
DINECDEDPNICLFGSCTNTPGGFQCLCPPGFVLSDNGRRCF

SEQ ID NO: 350 - protein, 42 aa, Homo sapiens
DVNECLESPGICSNGQCINTDGSFRCECPMGYNLDYTGVRCV

SEQ ID NO: 351 - protein, 40 aa, Homo sapiens
DTDECSIGNPCGNGTCTNVIGSFECNCNEGFEPGPMMNCE

SEQ ID NO: 352 - protein, 41 aa, Homo sapiens
DINECAQNPLLCAFRCMNTFGSYECTCPIGYALREDQKMCK

SEQ ID NO: 353 - protein, 44 aa, Homo sapiens
DLDECAEGLHDCESRGMMCKNLIGTFMCICPPGMARRPDGEGCV

SEQ ID NO: 354 - protein, 42 aa, Homo sapiens
DVDECQAIPGICQGGNCINTVGSFECRCPAGHKQSETTQKCE

SEQ ID NO: 355 - protein, 42 aa, Homo sapiens
DENECRTKPGICENGRCVNIIGSYRCECNEGFQSSSSGTECL

SEQ ID NO: 356 - protein, 42 aa, Homo sapiens
DIDECKVMPNLCTNGQCINTMGSFRCFCKVGYTTDISGTSCI

SEQ ID NO: 357 - protein, 41 aa, Homo sapiens
DLDECSQSPKPCNYICKNTEGSYQCSCPRGYVLQEDGKTCK

SEQ ID NO: 358 - protein, 38 aa, Homo sapiens
DLDECQTKQHNCQFLCVNTLGGFTCKCPPGFTQHHTAC

SEQ ID NO: 359 - protein, 43 aa, Homo sapiens
DNNECGSQPSLCGAKGICQNTPGSFSCECQRGFSLDATGLNCE

SEQ ID NO: 360 - protein, 40 aa, Homo sapiens
DVDECDGNHRCQHGCQNILGGYRCGCPQGYIQHYQWNQCV

SEQ ID NO: 361 - protein, 41 aa, Homo sapiens
DENECSNPNACGSASCYNTLGSYKCACPSGFSFDQFSSACH

SEQ ID NO: 362 - protein, 40 aa, Homo sapiens
DVNECSSSKNPCNYGCSNTEGGYLCGCPPGYYRVGQGHCV

SEQ ID NO: 363 - protein, 42 aa, Homo sapiens
DIDECSIIPGICETGECSNTVGSYFCVCPRGYVTSTDGSRCI

SEQ ID NO: 364 - protein, 41 aa, Homo sapiens
TIDICKHHANLCLNGRCIPTVSSYRCECNMGYKQDANGDCI

SEQ ID NO: 365 - protein, 40 aa, Homo sapiens
DVDECTSNPCTNGDCVNTPGSYYCKCHAGFQRTPTKQACI

SEQ ID NO: 366 - protein, 42 aa, Homo sapiens
DIDECIQNGVLCKNGRCVNTDGSFQCICNAGFELTTDGKNCV

SEQ ID NO: 367 - protein, 41 aa, Homo sapiens
DHDECTTTNMCLNGMCINEDGSFKCICKPGFVLAPNGRYCT

SEQ ID NO: 368 - protein, 33 aa, Homo sapiens
GQPICDRGCHNGGRCIGPNRCACVYGFMGPQCE

SEQ ID NO: 369 - protein, 40 aa, Homo sapiens
DVDECLSSPCVSGVCRNLAGSYTCKCGPGSRLDPSGTFCL

SEQ ID NO: 370 - protein, 42 aa, Homo sapiens
DVNECESFPGVCPNGRCVNTAGSFRCECPEGLMLDASGRLCV

SEQ ID NO: 371 - protein, 42 aa, Homo sapiens
DVNECKVFPGLCTHGTCRNTVGSFHCACAGGFALDAQERNCT

SEQ ID NO: 372 - protein, 43 aa, Homo sapiens
DIDECRISPDLCGQGTCVNTPGSFECECFPGYESGFMLMKNCM

SEQ ID NO: 373 - protein, 42 aa, Homo sapiens
DVDECARDPLLCRGGTCTNTDGSYKCQCPPGHELTAKGTACE

SEQ ID NO: 374 - protein, 42 aa, Homo sapiens
DIDECSLSDGLCPHGQCVNVIGAFQCSCHAGFQSTPDRQGCV

SEQ ID NO: 375 - protein, 41 aa, Homo sapiens
DINECRVQNGGCDVHCINTEGSYRCSCGQGYSLMPDGRACA

SEQ ID NO: 376 - protein, 42 aa, Homo sapiens
DVDECEENPRVCDQGHCTNMPGGHRCLCYDGFMATPDMRTCV

SEQ ID NO: 377 - protein, 42 aa, Homo sapiens
DVDECDLNPHICLHGDCENTKGSFVCHCQLGYMVRKGATGCS

SEQ ID NO: 378 - protein, 41 aa, Homo sapiens
DVDECEVGGHNCDSHASCLNIPGSFSCRCLPGWVGDGFECH

SEQ ID NO: 379 - protein, 42 aa, Homo sapiens
DVDECQAVPGLCQGGSCVNMVGSFHCRCPVGHRLSDSSAACE

SEQ ID NO: 380 - protein, 41 aa, Homo sapiens
DLDECVSQEHRCSPRGDCLNVPGSYRCTCRQGFAGDGFFCE

SEQ ID NO: 381 - protein, 42 aa, Homo sapiens
DRDECAENVDLCDNGQCLNAPGGYRCECEMGFDPTEDHRACQ

SEQ ID NO: 382 - protein, 41 aa, Homo sapiens
DVDECAQGNLCAFGSCENLPGMFRCICNGGYELDRGGGNCT

SEQ ID NO: 383 - protein, 41 aa, Homo sapiens
DINECADPVNCINGVCINTPGSYLCSCPQDFELNPSGVGCV

SEQ ID NO: 384 - protein, 42 aa, Homo sapiens
DIDECQELPGLCQGGDCVNTFGSFQCECPPGYHLSEHTRICE

SEQ ID NO: 385 - protein, 42 aa, Homo sapiens
DIDECSTHSGICGPGTCYNTLGNYTCVCPAEYLQVNGGNNCM

SEQ ID NO: 386 - protein, 42 aa, Homo sapiens
DIDECGEIPAICANGICINQIGSFRCECPAGFNYNSILLACE

SEQ ID NO: 387 - protein, 42 aa, Homo sapiens
DVDECGSRESPCQQNADCINIPGSYRCKCTRGYKLSPGGACV

SEQ ID NO: 388 - protein, 42 aa, Homo sapiens
GRNECREIPNVCSHGDCMDTEGSYMCLCHRGFQASADQTLCM

SEQ ID NO: 389 - protein, 39 aa, Homo sapiens
DIDECDRQPCGNGTCKNIIGSYNCLCFPGFVVTHNGDCV

SEQ ID NO: 390 - protein, 41 aa, Homo sapiens
TIDICRHFTNLCLNGRCLPTPSSYRCECNVGYTQDVRGECI

SEQ ID NO: 391 - protein, 43 aa, Homo sapiens
DFDECTTLVGQVCRFGHCLNTAGSFHCLCQDGFELTADGKNCV

SEQ ID NO: 392 - protein, 40 aa, Homo sapiens
DTNECLSLAGTCLPGTCQNLEGSFRCICPPGFQVQSDHCI

SEQ ID NO: 393 - protein, 42 aa, Homo sapiens
DIDECSEEPNLCLFGTCTNSPGSFQCLCPPGFVLSDNGHRCF

SEQ ID NO: 394 - protein, 42 aa, Homo sapiens
DVNECAENPGVCTNGVCVNTDGSFRCECPFGYSLDFTGINCV

SEQ ID NO: 395 - protein, 40 aa, Homo sapiens
DTDECSVGHPCGQGTCTNVIGGFECACADGFEPGLMMTCE

SEQ ID NO: 396 - protein, 41 aa, Homo sapiens
DIDECSLNPLLCAFRCHNTEGSYLCTCPAGYTLREDGAMCR

SEQ ID NO: 397 - protein, 45 aa, Homo sapiens
DVDECADGQQDCHARGMECKNLIGTFACVCPPGMRPLPGSGEGCT

SEQ ID NO: 398 - protein, 42 aa, Homo sapiens
DDNECHAQPDLCVNGRCVNTAGSFRCDCDEGFQPSPTLTECH

SEQ ID NO: 399 - protein, 42 aa, Homo sapiens
DVDECRMLAHLCAHGECINSLGSFRCHCQAGYTPDATATTCL

SEQ ID NO: 400 - protein, 41 aa, Homo sapiens
DMDECSQVPKPCTFLCKNTKGSFLCSCPRGYLLEEDGRTCK

SEQ ID NO: 401 - protein, 40 aa, Homo sapiens
DVDECTSSPCHHGDCVNIPGTYHCRCYPGFQATPTRQACV

SEQ ID NO: 402 - protein, 39 aa, Homo sapiens
DLDECTSRQHNCQFLCVNTVGAFTCRCPPGFTQHHQACF

SEQ ID NO: 403 - protein, 43 aa, Homo sapiens
DNDECSAQPGPCGAHGHCHNTPGSFRCECHQGFTLVSSGHGCE

SEQ ID NO: 404 - protein, 40 aa, Homo sapiens
DVNECDGPHRCQHGCQNQLGGYRCSCPQGFTQHSQWAQCV

SEQ ID NO: 405 - protein, 42 aa, Homo sapiens
DENECALSPPTCGSASCRNTLGGFRCVCPSGFDFDQALGGCQ

SEQ ID NO: 406 - protein, 40 aa, Homo sapiens
EVDECAGRRGPCSYSCANTPGGFLCGCPQGYFRAGQGHCV

SEQ ID NO: 407 - protein, 42 aa, Homo sapiens
DVDECIVSGGLCHLGRCVNTEGSFQCVCNAGFELSPDGKNCV

SEQ ID NO: 408 - protein, 41 aa, Homo sapiens
DHNECATSTMCVNGVCLNEDGSFSCLCKPGFLLAPGGHYCM

SEQ ID NO: 409 - protein, 41 aa, Homo sapiens
DIDECQTPGICVNGHCTNTEGSFRCQCLGGLAVGTDGRVCV

SEQ ID NO: 410 - protein, 42 aa, Homo sapiens
DINECALDPEVCANGVCENLRGSYRCVCNLGYEAGASGKDCT

SEQ ID NO: 411 - protein, 42 aa, Homo sapiens
DVDECALNSLLCDNGWCQNSPGSYSCSCPPGFHFWQDTEICK

SEQ ID NO: 412 - protein, 40 aa, Homo sapiens
LNDRCRGGGPCKQQCRDTGDEVVCSCFVGYQLLSDGVSCE

SEQ ID NO: 413 - protein, 46 aa, Homo sapiens
DVNECITGSHSCRLGESCINTVGSFRCQRDSSCGTGYELTEDNSCK

SEQ ID NO: 414 - protein, 46 aa, Homo sapiens
DIDECESGIHNCLPDFICQNTLGSFRCRPKLQCKSGFIQDALGNCI

SEQ ID NO: 415 - protein, 48 aa, Homo sapiens
DINECLSISAPCPIGHTCINTEGSYTCQKNVPNCGRGYHLNEEGTRCV

SEQ ID NO: 416 - protein, 43 aa, Homo sapiens
DVDECAPPAEPCGKGHRCVNSPGSFRCECKTGYYFDGISRMCV

SEQ ID NO: 417 - protein, 42 aa, Homo sapiens
DVNECQRYPGRLCGHKCENTLGSYLCSCSVGFRLSVDGRSCE

SEQ ID NO: 418 - protein, 40 aa, Homo sapiens
DINECSSSPCSQECANVYGSYQCYCRRGYQLSDVDGVTCE

SEQ ID NO: 419 - protein, 44 aa, Homo sapiens
DIDECALPTGGHICSYRCINIPGSFQCSCPSSGYRLAPNGRNCQ

SEQ ID NO: 420 - protein, 54 aa, Homo sapiens
DIDECVTGIHNCSINETCFNIQGGFRCLAFECPENYRRSAATLQQEKTDTVRCI

SEQ ID NO: 421 - protein, 42 aa, Homo sapiens
DQDECLLLPGELCQHLCINTVGSYHCACFPGFSLQDDGRTCR

SEQ ID NO: 422 - protein, 45 aa, Homo sapiens
DVDECALGTHNCSEAETCHNIQGSFRCLRFECPPNYVQVSKTKCE

SEQ ID NO: 423 - protein, 40 aa, Homo sapiens
QPNTCKDNGPCKQVCSTVGGSAICSCFPGYAIMADGVSCE

SEQ ID NO: 424 - protein, 45 aa, Homo sapiens
DINECVTDLHTCSRGEHCVNTLGSFHCYKALTCEPGYALKDGECE

SEQ ID NO: 425 - protein, 46 aa, Homo sapiens
DVDECAMGTHTCQPGFLCQNTKGSFYCQARQRCMDGFLQDPEGNCV

SEQ ID NO: 426 - protein, 48 aa, Homo sapiens
DINECTSLSEPCRPGFSCINTVGSYTCQRNPLICARGYHASDDGTKCV

SEQ ID NO: 427 - protein, 43 aa, Homo sapiens
DVNECETGVHRCGEGQVCHNLPGSYRCDCKAGFQRDAFGRGCI

SEQ ID NO: 428 - protein, 42 aa, Homo sapiens
DVNECWASPGRLCQHTCENTLGSYRCSCASGFLLAADGKRCE

SEQ ID NO: 429 - protein, 39 aa, Homo sapiens
DVNECEAQRCSQECANIYGSYQCYCRQGYQLAEDGHTCT

SEQ ID NO: 430 - protein, 43 aa, Homo sapiens
DIDECAQGAGILCTFRCLNVPGSYQCACPEQGYTMTANGRSCK

SEQ ID NO: 431 - protein, 41 aa, Homo sapiens
DIDECRTIPEACRGDMMCVNQNGGYLCIPRTNPVYRGPYSN

SEQ ID NO: 432 - protein, 41 aa, Homo sapiens
DVDECATDSHQCNPTQICINTEGGYTCSCTDGYWLLEGQCL

SEQ ID NO: 433 - protein, 39 aa, Homo sapiens
DIDECRYGYCQQLCANVPGSYSCTCNPGFTLNEDGRSCQ

SEQ ID NO: 434 - protein, 40 aa, Homo sapiens
DVNECATENPCVQTCVNTYGSFICRCDPGYELEEDGVHCS

SEQ ID NO: 435 - protein, 41 aa, Homo sapiens
DMDECSFSEFLCQHECVNQPGTYFCSCPPGYILLDDNRSCQ

SEQ ID NO: 436 - protein, 46 aa, Homo sapiens
DINECEHRNHTCNLQQTCYNLQGGFKCIDPIRCEEPYLRISDNRCM

SEQ ID NO: 437 - protein, 40 aa, Homo sapiens
DEDECAAGNPCSHSCHNAMGTYYCSCPKGLTIAADGRTCQ

SEQ ID NO: 438 - protein, 45 aa, Homo sapiens
DIDECALGRHTCHAGQDCDNTIGSYRCVVRCGSGFRRTSDGLSCQ

SEQ ID NO: 439 - protein, 38 aa, Homo sapiens
DINECQESSPCHQRCFNAIGSFHCGCEPGYQLKGRKCM

SEQ ID NO: 440 - protein, 42 aa, Homo sapiens
DVNECRQNVCRPDQHCKNTRGGYKCIDLCPNGMTKAENGTCI

SEQ ID NO: 441 - protein, 36 aa, Homo sapiens
DIDECKDGTHQCRYNQICENTRGSYRCVCPRGYRSQ

SEQ ID NO: 442 - protein, 41 aa, Homo sapiens
DINECEQVPKPCAHQCSNTPGSFKCICPPGQHLLGDGKSCA

SEQ ID NO: 443 - protein, 40 aa, Homo sapiens
DIDECENTDACQHECKNTFGSYQCICPPGYQLTHNGKTCQ

SEQ ID NO: 444 - protein, 37 aa, Homo sapiens
GISECSSQPCQNGGTCVEGVNQYRCICPPGRTGNRCQ

SEQ ID NO: 445 - protein, 46 aa, Homo sapiens
DVNECELYGQEGRPRLCMHACVNTPGSYRCTCPGGYRTLADGKSCE

SEQ ID NO: 446 - protein, 50 aa, Homo sapiens
DVDECVGLQPVCPQGTTCINTGGSFQCVSPECPEGSGNVSYVKTSPFQCE

SEQ ID NO: 447 - protein, 39 aa, Homo sapiens
DVDECAQALHDRRPSQDCHNLSGSYQCTCPDGYRKIGPE

SEQ ID NO: 448 - protein, 24 aa, Homo sapiens
SFRCQCEPGFQLGPNNRSCVDVNE

SEQ ID NO: 449 - protein, 23 aa, Homo sapiens
FLCRCHQGYELHRDGFSCSDIDE

SEQ ID NO: 450 - protein, 22 aa, Homo sapiens
KCLCPLGFLLANDSKTCEDIDE

SEQ ID NO: 451 - protein, 24 aa, Homo sapiens
SFYCSCRPGYKLMSDKRTCVDIDE

SEQ ID NO: 452 - protein, 40 aa, Homo sapiens
DIDECTEMPFVCSQKCENVIGSYICKCAPGYLREPDGKTC

SEQ ID NO: 453 - protein, 31 aa, Homo sapiens
DINECEQFGTCPQHCRNTKGSYECVCADGFT

SEQ ID NO: 454 - protein, 39 aa, Homo sapiens
LPDQCTPNPCDRKGTQACQDLMGNFFCLCKAGWGGRLCD

SEQ ID NO: 455 - protein, 41 aa, Homo sapiens
DVNECSQENGGCLQICHNKPGSFHCSCHSGFELSSDGRTCQ

SEQ ID NO: 456 - protein, 41 aa, Homo sapiens
DIDECADSEACGEARCKNLPGSYSCLCDEGFAYSSQEKACR

SEQ ID NO: 457 - protein, 41 aa, Homo sapiens
DVDECLQGRCEQVCVNSPGSYTCHCDGRGGLKLSQDMDTCE

SEQ ID NO: 458 - protein, 28 aa, Homo sapiens
ECSRLCRNGYCTPTGKCCCSPGWEGDFC

SEQ ID NO: 459 - protein, 33 aa, Homo sapiens
RTAKCEPACRHGGVCVRPNKCLCKKGYLGPQCE

SEQ ID NO: 460 - protein, 41 aa, Homo sapiens
DRDECSGGPSPCSHACLNAPGRFSCTCPTGFALAWDDRNCR

SEQ ID NO: 461 - protein, 44 aa, Homo sapiens
DVDECAWDAHLCREGQRCVNLLGSYRCLPDCGPGFRVADGAGCE

SEQ ID NO: 462 - protein, 39 aa, Homo sapiens
DVDECLEGLDDCHYNQLCENTPGGHRCSCPRGYRMQGPS

SEQ ID NO: 463 - protein, 41 aa, Homo sapiens
DVNECLQLPKACAYQCHNLQGSYRCLCPPGQTLLRDGKACT

SEQ ID NO: 464 - protein, 40 aa, Homo sapiens
DLDECRVRNLCQHACRNTEGSYQCLCPAGYRLLPSGKNCQ

SEQ ID NO: 465 - protein, 39 aa, Homo sapiens
ALDPCASGPCLNGGSCSNTQDPQSYHCSCPRAFTGKDCG

SEQ ID NO: 466 - protein, 39 aa, Homo sapiens
RHTACLSSPCLNGGTCHLIVATGTTVCACPPGFAGRLCN

SEQ ID NO: 467 - protein, 30 aa, Homo sapiens
ECPGGCRNGGFCNERRICECPDGFHGPHCE

SEQ ID NO: 468 - protein, 30 aa, Homo sapiens
LCTPRCMNGGLCVTPGFCICPPGFYGVNCD

SEQ ID NO: 469 - protein, 30 aa, Homo sapiens
NCSTTCFNGGTCFYPGKCICPPGLEGEQCE

SEQ ID NO: 470 - protein, 30 aa, Homo sapiens
KCPQPCRNGGKCIGKSKCKCSKGYQGDLCS

SEQ ID NO: 471 - protein, 30 aa, Homo sapiens
VCEPGCGAHGTCHEPNKCQCQEGWHGRHCN

SEQ ID NO: 472 - protein, 30 aa, Homo sapiens
PCQNGGQCHDSESSSYVCVCPAGFTGSRCE

SEQ ID NO: 473 - protein, 30 aa, Homo sapiens
CGPDATCVNRPDGRGYTCRCHLGRSGLRCE

SEQ ID NO: 474 - protein, 37 aa, Homo sapiens
QADPCQPNPCEHGGDCLVHGSTFTCSCLAPFSGNKCQ

SEQ ID NO: 475 - protein, 38 aa, Homo sapiens
VQNTCKDNPCGRGQCLITQSPPYYRCVCKHPYTGPSCS

SEQ ID NO: 476 - protein, 39 aa, Homo sapiens
VVPVCRPNPCQNGATCSRHKRRSKFTCACPDQFKGKFCE

SEQ ID NO: 477 - protein, 74 aa, Homo sapiens
LCSQALCSGHGRCVRRTSHPKALLLLNPASFSIQLTPGGGPLSLRGALSLGDQAQMAVEFKCRCYPGWQAPWCE

SEQ ID NO: 478 - protein, 60 aa, Homo sapiens
ATQYCSRAQCHGHGRCVRRNPSASTFLHLSTNSFRLVPGHAPGEPQLRPVGELSWADIDH

SEQ ID NO: 479 - protein, 56 aa, Homo sapiens
AAMACSHQRCHGHGRCARRDPGQMEAFLHLWPDGSLGDWKSFSCHCYWGWAGPTCQ

SEQ ID NO: 480 - protein, 73 aa, Homo sapiens
VCSLHLCRNNGRCIRKMWNAPSYLHLNPASYHIEASEDGEFTVKGKASDTDLAVMADTFSCHCYQGYEGADCR

SEQ ID NO: 481 - protein, 38 aa, Homo sapiens
EITACSSSPCFHDGTCVLDKAGSYKCACLAGYTGQRCE

SEQ ID NO: 482 - protein, 34 aa, Homo sapiens
ECIDDETEEICGGHGKCYCGNCYCKAGWHGDKCE

SEQ ID NO: 483 - protein, 37 aa, Homo sapiens
DCRAVYDRYSDDFCSGHGQCNCGRCDCKAGWYGKKCE

SEQ ID NO: 484 - protein, 33 aa, Homo sapiens
RCEDLDGVVCGGHGTCSCGRCVCERGWFGKLCQ

SEQ ID NO: 485 - protein, 39 aa, Homo sapiens
QADPCKFLACGEFAQCVKNERTEEAECRCKPGYDSQGSL

SEQ ID NO: 486 - protein, 42 aa, Homo sapiens
EANPCKFQACNEFSECLVNPWSGEAKCRCFPGYLSVEERPCQ

SEQ ID NO: 487 - protein, 42 aa, Homo sapiens
SLCDLQPDFCLNDGKCDIMPGHGAICRCRVGENWWYRGKHCE

SEQ ID NO: 488 - protein, 32 aa, Homo sapiens
DRCQLQTRCQNGGQWDGLKCQCPSTFYGSSCE

SEQ ID NO: 489 - protein, 32 aa, Homo sapiens
CDNGGTWEQGQCACLPGFSGDRCQLQTRCQNG

SEQ ID NO: 490 - protein, 34 aa, Homo sapiens
CASAPCRNGGVCREGWNRFICDCIGTGFLGRVCE

SEQ ID NO: 491 - protein, 44 aa, Homo sapiens
LDICSKNPCHNGGLCEEISQEVRGDVFPSYTCTCLKGYAGNHCE

SEQ ID NO: 492 - protein, 57 aa, Homo sapiens
CICYGHASSCPWDETTKKLQCQCEHNTCGESCNRCCPGYHQQPWRPGTVSSGNTCEA

SEQ ID NO: 493 - protein, 46 aa, Homo sapiens
CDCPHTQNTCDPETGECVCPPHTQGVKCEECEDGHWGYDAEVGCQA

SEQ ID NO: 494 - protein, 46 aa, Homo sapiens
CNCSLVGSTHHRCDVVTGHCQCKSKFGGRACDQCSLGYRDFPDCVP

SEQ ID NO: 495 - protein, 60 aa, Homo sapiens
CDCDLRGTSGDACNLEQGLCGCVEETGACPCKENVFGPQCNECREGTFALRADNPLGCSP

SEQ ID NO: 496 - protein, 49 aa, Homo sapiens
CSCNNHSDTCDPNTGKCLNCGDNTAGDHCDVCTSGYYGKVTGSASDCAL

SEQ ID NO: 497 - protein, 57 aa, Homo sapiens
CACPHSPPASFSPTCVLEGDHDFRCDACLLGYEGKHCERCSSSYYGNPQTPGGSCQK

SEQ ID NO: 498 - protein, 47 aa, Homo sapiens
CDCNPHGSVHGDCDRTSGQCVCRLGASGLRCDECEPRHILMETDCVS

SEQ ID NO: 499 - protein, 70 aa, Homo sapiens
CNCHNKAKDCYYDESVAKQKKSLNTAGQFRGGGVCINCLQNTMGINCETCIDGYYRPHKVSPYEDEPCRP

SEQ ID NO: 500 - protein, 57 aa, Homo sapiens
CNCDPVGSLSSVCIKDDLHSDLHNGKQPGQCPCKEGYTGEKCDRCQLGYKDYPTCVS

SEQ ID NO: 501 - protein, 49 aa, Homo sapiens
CGCNPVGSASDEPCTGPCVCKENVEGKACDRCKPGFYNLKEKNPRGCSE

SEQ ID NO: 502 - protein, 49 aa, Homo sapiens
CECHGHAAECNVHGVCIACAHNTTGVHCEQCLPGFYGEPSRGTPGDCQP

SEQ ID NO: 503 - protein, 58 aa, Homo sapiens
CACPLTIASNNFSPTCHLNDGDEVVCDWCAPGYSGAWCERCADGYYGNPTVPGESCVP

SEQ ID NO: 504 - protein, 53 aa, Homo sapiens
CDCSGNVDPSEAGHCDSVTGECLKCLGNTDGAHCERCADGFYGDAVTAKNCRA

SEQ ID NO: 505 - protein, 49 aa, Homo sapiens
CECHVKGSHSAVCHLETGLCDCKPNVTGQQCDQCLHGYYGLDSGHGCRP

SEQ ID NO: 506 - protein, 47 aa, Homo sapiens
CNCSVAGSVSDGCTDEGQCHCVPGVAGKRCDRCAHGFYAYQDGSCTP

SEQ ID NO: 507 - protein, 57 aa, Homo sapiens
CICYGHARACPLDPATNKSRCECEHNTCGDSCDQCCPGFHQKPWRAGTFLTKTECEA

SEQ ID NO: 508 - protein, 46 aa, Homo sapiens
CECSHLGNNCDPKTGRCICPPNTIGEKCSKCAPNTWGHSITTGCKA

SEQ ID NO: 509 - protein, 46 aa, Homo sapiens
CNCSTVGSLDFQCNVNTGQCNCHPKFSGAKCTECSRGHWNYPRCNL

SEQ ID NO: 510 - protein, 60 aa, Homo sapiens
CDCFLPGTDATTCDSETKKCSCSDQTGQCTCKVNVEGIHCDRCRPGKFGLDAKNPLGCSS

SEQ ID NO: 511 - protein, 49 aa, Homo sapiens
CQCNGHSSLCDPETSICQNCQHHTAGDFCERCALGYYGIVKGLPNDCQQ

SEQ ID NO: 512 - protein, 58 aa, Homo sapiens
CACPLISSSNNFSPSCVAEGLDDYRCTACPRGYEGQYCERCAPGYTGSPGNPGGSCQE

SEQ ID NO: 513 - protein, 47 aa, Homo sapiens
CECDPYGSLPVPCDPVTGFCTCRPGATGRKCDGCKHWHAREGWECVF

SEQ ID NO: 514 - protein, 70 aa, Homo sapiens
CNCHGKAEECYYDENVARRNLSLNIRGKYIGGGVCINCTQNTAGINCETCTDGFFRPKGVSPNYPRPCQP

SEQ ID NO: 515 - protein, 55 aa, Homo sapiens
CHCDPIGSLNEVCVKDEKHARRGLAPGSCHCKTGFGGVSCDRCARGYTGYPDCKA

SEQ ID NO: 516 - protein, 49 aa, Homo sapiens
CNCSGLGSKNEDPCFGPCICKENVEGGDCSRCKSGFFNLQEDNWKGCDE

SEQ ID NO: 517 - protein, 50 aa, Homo sapiens
CQCFGHAESCDDVTGECLNCKDHTGGPYCDKCLPGFYGEPTKGTSEDCQP

SEQ ID NO: 518 - protein, 58 aa, Homo sapiens
CACPLNIPSNNFSPTCHLDRSLGLICDGCPVGYTGPRCERCAEGYFGQPSVPGGSCQP

SEQ ID NO: 519 - protein, 53 aa, Homo sapiens
CQCNDNLDFSIPGSCDSLSGSCLICKPGTTGRYCELCADGYFGDAVDAKNCQP

SEQ ID NO: 520 - protein, 49 aa, Homo sapiens
CRCNAGGSFSEVCHSQTGQCECRANVQGQRCDKCKAGTFGLQSARGCVP

SEQ ID NO: 521 - protein, 47 aa, Homo sapiens
CNCNSFGSKSFDCEESGQCWCQPGVTGKKCDRCAHGYFNFQEGGCTA

SEQ ID NO: 522 - protein, 57 aa, Homo sapiens
CVCNGHAEVCNINNPEKLFRCECQHHTCGETCDRCCTGYNQRRWRPAAWEQSHECEA

SEQ ID NO: 523 - protein, 44 aa, Homo sapiens
CSCGRRLCEEMTGQCRCPPRTVRPQCEVCETHSFSFHPMAGCEG

SEQ ID NO: 524 - protein, 49 aa, Homo sapiens
CNCSRRGTIEAAMPECDRDSGQCRCKPRITGRQCDRCASGFYRFPECVP

SEQ ID NO: 525 - protein, 51 aa, Homo sapiens
CNCNRDGTEPGVCDPGTGACLCKENVEGTECNVCREGSFHLDPANLKGCTS

SEQ ID NO: 526 - protein, 47 aa, Homo sapiens
CNCNGHSNQCQDGSGICVNCQHNTAGEHCERCQEGYYGNAVHGSCRA

SEQ ID NO: 527 - protein, 53 aa, Homo sapiens
CPCPHTNSFATGCVVNGGDVRCSCKAGYTGTQCERCAPGYFGNPQKFGGSCQP

SEQ ID NO: 528 - protein, 35 aa, Homo sapiens
CSCNSNGQLGSCHPLTGDCINQEPKDSSPAEECDD

SEQ ID NO: 529 - protein, 70 aa, Homo sapiens
CNCHGHASNCYYDPDVERQQASLNTQGIYAGGGVCINCQHNTAGVNCEQCAKGYYRPYGVPVDAPDGCIP

SEQ ID NO: 530 - protein, 44 aa, Homo sapiens
CSCDPEHADGCEQGSGRCHCKPNFHGDNCEKCAIGYYNFPFCLR

SEQ ID NO: 531 - protein, 45 aa, Homo sapiens
CDCNLEGVLPEICDAHGRCLCRPGVEGPRCDTCRSGFYSFPICQA

SEQ ID NO: 532 - protein, 53 aa, Homo sapiens
CWCSALGSYQMPCSSVTGQCECRPGVTGQRCDRCLSGAYDFPHCQGSSSACDP

SEQ ID NO: 533 - protein, 41 aa, Homo sapiens
GTINSNLGYCQCKLHVEGPTCSRCKLLYWNLDKENPSGCSE

SEQ ID NO: 534 - protein, 53 aa, Homo sapiens
CKCHKAGTVSGTGECRQGDGDCHCKSHVGGDSCDTCEDGYFALEKSNYFGCQG

SEQ ID NO: 535 - protein, 45 aa, Homo sapiens
CQCDIGGALSSMCSGPSGVCQCREHVVGKVCQRPENNYYFPDLHH

SEQ ID NO: 536 - protein, 46 aa, Homo sapiens
CECHPTGATGPHCSPEGGQCPCQPNVIGRQCTRCATGHYGFPRCKP

SEQ ID NO: 537 - protein, 50 aa, Homo sapiens
CDCNGNSNECLDGSGYCVHCQRNTTGEHCEKCLDGYIGDSIRGAPQFCQP

SEQ ID NO: 538 - protein, 55 aa, Homo sapiens
CPCPLPHLANFAESCYRKNGAVRCICNENYAGPNCERCAPGYYGNPLLIGSTCKK

SEQ ID NO: 539 - protein, 54 aa, Homo sapiens
CDCSGNSDPNLIFEDCDEVTGQCRNCLRNTTGFKCERCAPGYYGDARIAKNCAV

SEQ ID NO: 540 - protein, 59 aa, Homo sapiens
CVCHGHADACDAKDPTDPFRLQCTCQHNTCGGTCDRCCPGFNQQPWKPATANSANECQS

SEQ ID NO: 541 - protein, 53 aa, Homo sapiens
CSCDLRGTLGGVAECQPGTGQCFCKPHVCGQACASCKDGFFGLDQADYFGCRS

SEQ ID NO: 542 - protein, 22 aa, Homo sapiens
CRCDIGGALGQSCEPRTGVCRC

SEQ ID NO: 543 - protein, 46 aa, Homo sapiens
CGCHEVGATGPTCEPFGGQCPCHAHVIGRDCSRCATGYWGFPNCRP

SEQ ID NO: 544 - protein, 44 aa, Homo sapiens
CDCGARLCDELTGQCICPPRTIPPDCLLCQPQTFGCHPLVGCEE

SEQ ID NO: 545 - protein, 49 aa, Homo sapiens
CNCSGPGIQELTDPTCDTDSGQCKCRPNVTGRRCDTCSPGFHGYPRCRP

SEQ ID NO: 546 - protein, 51 aa, Homo sapiens
CDCHEAGTAPGVCDPLTGQCYCKENVQGPKCDQCSLGTFSLDAANPKGCTR

SEQ ID NO: 547 - protein, 49 aa, Homo sapiens
CQCHGHSDRCLPGSGVCVDCQHNTEGAHCERCQAGFVSSRDDPSAPCVS

SEQ ID NO: 548 - protein, 56 aa, Homo sapiens
CPCPLSVPSNNFAEGCVLRGGRTQCLCKPGYAGASCERCAPGFFGNPLVLGSSCQP

SEQ ID NO: 549 - protein, 54 aa, Homo sapiens
CDCSGNGDPNLLFSDCDPLTGACRGCLRHTTGPRCEICAPGFYGNALLPGNCTR

SEQ ID NO: 550 - protein, 47 aa, Homo sapiens
CDCTPCGTEACDPHSGHCLCKAGVTGRRCDRCQEGHFGFDGCGGCRP

SEQ ID NO: 551 - protein, 70 aa, Homo sapiens
CNCYGHATDCYYDPEVDRRRASQSLDGTYQGGGVCIDCQHHTTGVNCERCLPGFYRSPNHPLDSPHVCRR

SEQ ID NO: 552 - protein, 47 aa, Homo sapiens
CACGPAAEGSECHPQSGQCHCRPGTMGPQCRECAPGYWGLPEQGCRR

SEQ ID NO: 553 - protein, 50 aa, Homo sapiens
CQCPGGRCDPHTGRCNCPPGLSGERCDTCSQQHQVPVPGGPVGHSIHCEV

SEQ ID NO: 554 - protein, 46 aa, Homo sapiens
CNCESDFTDGTCEDLTGRCYCRPNFSGERCDVCAEGFTGFPSCYPT

SEQ ID NO: 555 - protein, 47 aa, Homo sapiens
CDCSAAGTQGNACRKDPRVGRCLCKPNFQGTHCELCAPGFYGPGCQP

SEQ ID NO: 556 - protein, 46 aa, Homo sapiens
CQCSSPGVADDRCDPDTGQCRCRVGFEGATCDRCAPGYFHFPLCQL

SEQ ID NO: 557 - protein, 45 aa, Homo sapiens
CGCSPAGTLPEGCDEAGRCLCQPEFAGPHCDRCRPGYHGFPNCQA

SEQ ID NO: 558 - protein, 45 aa, Homo sapiens
CTCDPRGALDQLCGAGGLCRCRPGYTGTACQECSPGFHGFPSCVP

SEQ ID NO: 559 - protein, 46 aa, Homo sapiens
CHCSAEGSLHAACDPRSGQCSCRPRVTGLRCDTCVPGAYNFPYCEA

SEQ ID NO: 560 - protein, 53 aa, Homo sapiens
GSCHPAGLAPVDPALPEAQVPCMCRAHVEGPSCDRCKPGFWGLSPSNPEGCTR

SEQ ID NO: 561 - protein, 64 aa, Homo sapiens
CFCYGHASECAPVDGFNEEVEGMVHGHCMCRHNTKGLNCELCMDFYHDLPWRPAEGRNSNACKK

SEQ ID NO: 562 - protein, 52 aa, Homo sapiens
CQCHNNIDTTDPEACDKETGRCLKCLYHTEGEHCQFCRFGYYGDALQQDCRK

SEQ ID NO: 563 - protein, 56 aa, Homo sapiens
CVCNYLGTVQEHCNGSDCQCDKATGQCLCLPNVIGQNCDRCAPNTWQLASGTGCDP

SEQ ID NO: 564 - protein, 48 aa, Homo sapiens
CNCNAAHSFGPSCNEFTGQCQCMPGFGGRTCSECQELFWGDPDVECRA

SEQ ID NO: 565 - protein, 47 aa, Homo sapiens
CDCDPRGIETPQCDQSTGQCVCVEGVEGPRCDKCTRGYSGVFPDCTP

SEQ ID NO: 566 - protein, 63 aa, Homo sapiens
CNCNEHSISCHFDMAVYLATGNVSGGVCDDCQHNTMGRNCEQCKPFYYQHPERDIRDPNFCER

SEQ ID NO: 567 - protein, 60 aa, Homo sapiens
CTCDPAGSQNEGICDSYTDFSTGLIAGQCRCKLNVEGEHCDVCKEGFYDLSSEDPFGCKS

SEQ ID NO: 568 - protein, 52 aa, Homo sapiens
CACNPLGTIPGGNPCDSETGHCYCKRLVTGQHCDQCLPEHWGLSNDLDGCRP

SEQ ID NO: 569 - protein, 31 aa, Homo sapiens
CDCDLGGALNNSCFAESGQCSCRPHMIGRQC

SEQ ID NO: 570 - protein, 48 aa, Homo sapiens
CECDPQGSLSSVCDPNGGQCQCRPNVVGRTCNRCAPGTFGFGPSGCKP

SEQ ID NO: 571 - protein, 46 aa, Homo sapiens
CECHLQGSVNAFCNPVTGQCHCFQGVYARQCDRCLPGHWGFPSCQP

SEQ ID NO: 572 - protein, 50 aa, Homo sapiens
CQCNGHADDCDPVTGECLNCQDYTMGHNCERCLAGYYGDPIIGSGDHCRP

SEQ ID NO: 573 - protein, 59 aa, Homo sapiens
CPCPDGPDSGRQFARSCYQDPVTLQLACVCDPGYIGSRCDDCASGYFGNPSEVGGSCQP

SEQ ID NO: 574 - protein, 64 aa, Homo sapiens
CFCYGHASECAPAPGAPAHAEGMVHGACICKHNTRGLNCEQCQDFYRDLPWRPAEDGHSHACRK

SEQ ID NO: 575 - protein, 52 aa, Homo sapiens
CECSGNIDPMDPDACDPHTGQCLRCLHHTEGPHCAHCKPGFHGQAARQSCHR

SEQ ID NO: 576 - protein, 57 aa, Homo sapiens
CTCNLLGTNPQQCPSPDQCHCDPSSGQCPCLPNVQGPSCDRCAPNFWNLTSGHGCQP

SEQ ID NO: 577 - protein, 48 aa, Homo sapiens
CACHPSRARGPTCNEFTGQCHCRAGFGGRTCSECQELHWGDPGLQCHA

SEQ ID NO: 578 - protein, 47 aa, Homo sapiens
CDCDSRGIDTPQCHRFTGHCSCRPGVSGVRCDQCARGFSGIFPACHP

SEQ ID NO: 579 - protein, 63 aa, Homo sapiens
CECHGHTHSCHFDMAVYLASGNVSGGVCDGCQHNTAGRHCELCRPFFYRDPTKDLRDPAVCRS

SEQ ID NO: 580 - protein, 60 aa, Homo sapiens
CDCDPMGSQDGGRCDSHDDPALGLVSGQCRCKEHVVGTRCQQCRDGFFGLSISDRLGCRR

SEQ ID NO: 581 - protein, 52 aa, Homo sapiens
CQCNARGTVPGSTPCDPNSGSCYCKRLVTGRGCDRCLPGHWGLSHDLLGCRP

SEQ ID NO: 582 - protein, 31 aa, Homo sapiens
CDCDVGGALDPQCDEGTGQCHCRQHMVGRRC

SEQ ID NO: 583 - protein, 48 aa, Homo sapiens
CQCNPQGSLSSECNPHGGQCLCKPGVVGRRCDLCAPGYYGFGPTGCQA

SEQ ID NO: 584 - protein, 46 aa, Homo sapiens
CQCSHEGALSSLCEKTSGQCLCRTGAFGLRCDRCQRGQWGFPSCRP

SEQ ID NO: 585 - protein, 50 aa, Homo sapiens
CVCNGHADECNTHTGACLGCRDHTGGEHCERCIAGFHGDPRLPYGGQCRP

SEQ ID NO: 586 - protein, 59 aa, Homo sapiens
CPCPEGPGSQRHFATSCHQDEYSQQIVCHCRAGYTGLRCEACAPGHFGDPSRPGGRCQL

SEQ ID NO: 587 - protein, 66 aa, Homo sapiens
CFCHGHADRCAPKPGASAGPSTAVQVHDVCVCQHNTAGPNCERCAPFYNNRPWRPAEGQDAHECQR

SEQ ID NO: 588 - protein, 63 aa, Homo sapiens
CDCNGHSETCHFDPAVFAASQGAYGGVCDNCRDHTEGKNCERCQLHYFRNRRPGASIQETCIS

SEQ ID NO: 589 - protein, 52 aa, Homo sapiens
CECDPDGAVPGAPCDPVTGQCVCKEHVQGERCDLCKPGFTGLTYANPQGCHR

SEQ ID NO: 590 - protein, 50 aa, Homo sapiens
CDCNILGSRRDMPCDEESGRCLCLPNVVGPKCDQCAPYHWKLASGQGCEP

SEQ ID NO: 591 - protein, 53 aa, Homo sapiens
CACDPHNSLSPQCNQFTGQCPCREGFGGLMCSAAAIRQCPDRTYGDVATGCRA

SEQ ID NO: 592 - protein, 47 aa, Homo sapiens
CDCDFRGTEGPGCDKASGRCLCRPGLTGPRCDQCQRGYCNRYPVCVA

SEQ ID NO: 593 - protein, 67 aa, Homo sapiens
CFCNGHASECRPMQKMRGDVFSPPGMVHGQCVCQHNTDGPNCERCKDFFQDAPWRPAADLQDNACRS

SEQ ID NO: 594 - protein, 52 aa, Homo sapiens
CACNNNIDVTDPESCSRVTGECLRCLHNTQGANCQLCKPGHYGSALNQTCRR

SEQ ID NO: 595 - protein, 58 aa, Homo sapiens
CSCHASGVSPMECPPGGGACLCDPVTGACPCLPNVTGLACDRCADGYWNLVPGRGCQS

SEQ ID NO: 596 - protein, 48 aa, Homo sapiens
CDCDPRTSQSSHCDQLTGQCPCKLGYGGKRCSECQENYYGDPPGRCIP

SEQ ID NO: 597 - protein, 47 aa, Homo sapiens
CDCNRAGTQKPICDPDTGMCRCREGVSGQRCDRCARGHSQEFPTCLQ

SEQ ID NO: 598 - protein, 63 aa, Homo sapiens
CSCNSHSSRCHFDMTTYLASGGLSGGVCEDCQHNTEGQHCDRCRPLFYRDPLKTISDPYACIP

SEQ ID NO: 599 - protein, 60 aa, Homo sapiens
CECDPDGTISGGICVSHSDPALGSVAGQCLCKENVEGAKCDQCKPNHYGLSATDPLGCQP

SEQ ID NO: 600 - protein, 51 aa, Homo sapiens
CDCNPLGSLPFLTCDVDTGQCLCLSYVTGAHCEECTVGYWGLGNHLHGCSP

SEQ ID NO: 601 - protein, 47 aa, Homo sapiens
CDCDIGGAYSNVCSPKNGQCECRPHVTGRSCSEPAPGYFFAPLNFYL

SEQ ID NO: 602 - protein, 48 aa, Homo sapiens
CKCHPQGSVGSSCSRLGGQCQCKPLVVGRCCDRCSTGSYDLGHHGCHP

SEQ ID NO: 603 - protein, 46 aa, Homo sapiens
CHCHPQGSKDTVCDQVTGQCPCHGEVSGRRCDRCLAGYFGFPSCHP

SEQ ID NO: 604 - protein, 48 aa, Homo sapiens
CPCNRFAELCDPETGSCFNCGGFTTGRNCERCIDGYYGNPSSGQPCRP

SEQ ID NO: 605 - protein, 59 aa, Homo sapiens
CLCPDDPSSNQYFAHSCYQNLWSSDVICNCLQGYTGTQCGECSTGFYGNPRISGAPCQP

SEQ ID NO: 606 - protein, 56 aa, Homo sapiens
CKCNGHASECMKNEFDKLVCNCKHNTYGVDCEKCLPFFNDRPWRRATAESASECLP

SEQ ID NO: 607 - protein, 48 aa, Homo sapiens
CDCHPEGSLSLQCKDDGRCECREGFVGNRCDQCEENYFYNRSWPGCQE

SEQ ID NO: 608 - protein, 56 aa, Homo sapiens
CDCNGRSQECYFDPELYRSTGHGGHCTNCQDNTDGAHCERCRENFFRLGNNEACSS

SEQ ID NO: 609 - protein, 47 aa, Homo sapiens
CHCSPVGSLSTQCDSYGRCSCKPGVMGDKCDRCQPGFHSLTEAGCRP

SEQ ID NO: 610 - protein, 50 aa, Homo sapiens
CSCDPSGSIDECNIETGRCVCKDNVEGFNCERCKPGFFNLESSNPRGCTP

SEQ ID NO: 611 - protein, 49 aa, Homo sapiens
CACNGHSETCDPETGVCNCRDNTAGPHCEKCSDGYYGDSTAGTSSDCQP

SEQ ID NO: 612 - protein, 55 aa, Homo sapiens
CPCPGGSSCAVVPKTKEVVCTNCPTGTTGKRCELCDDGYFGDPLGRNGPVRLCRL

SEQ ID NO: 613 - protein, 56 aa, Homo sapiens
CQCSDNIDPNAVGNCNRLTGECLKCIYNTAGFYCDRCKDGFFGNPLAPNPADKCKA

SEQ ID NO: 614 - protein, 51 aa, Homo sapiens
CNCNLYGTMKQQSSCNPVTGQCECLPHVTGQDCGACDPGFYNLQSGQGCER

SEQ ID NO: 615 - protein, 48 aa, Homo sapiens
CDCHALGSTNGQCDIRTGQCECQPGITGQHCERCEVNHFGFGPEGCKP

SEQ ID NO: 616 - protein, 56 aa, Homo sapiens
CDCNGKSRQCIFDRELHRQTGNGFRCLNCNDNTDGIHCEKCKNGFYRHRERDRCLP

SEQ ID NO: 617 - protein, 47 aa, Homo sapiens
CNCNSKGSLSARCDNSGRCSCKPGVTGARCDRCLPGFHMLTDAGCTQ

SEQ ID NO: 618 - protein, 48 aa, Homo sapiens
CDCDPAGIAGPCDAGRCVCKPAVTGERCDRCRSGYYNLDGGNPEGCTQ

SEQ ID NO: 619 - protein, 46 aa, Homo sapiens
CNCQGGGACDPDTGDCYSGDENPDIECADCPIGFYNDPHDPRSCKP

SEQ ID NO: 620 - protein, 55 aa, Homo sapiens
CPCHNGFSCSVMPETEEVVCNNCPPGVTGARCELCADGYFGDPFGEHGPVRPCQP

SEQ ID NO: 621 - protein, 56 aa, Homo sapiens
CQCNNNVDPSASGNCDRLTGRCLKCIHNTAGIYCDQCKAGYFGDPLAPNPADKCRA

SEQ ID NO: 622 - protein, 30 aa, Homo sapiens
CNCNPMGSEPVGCRSDGTCVCKPGFGGPNC

SEQ ID NO: 623 - protein, 56 aa, Homo sapiens
CKCNGHASECGPDVAGQLACRCQHNTTGTDCERCLPFFQDRPWARGTAEAAHECLP

SEQ ID NO: 624 - protein, 49 aa, Homo sapiens
CRCSPLGAASAQCHENGTCVCRPGFEGYKCDRCHDNFFLTADGTHCQQC

SEQ ID NO: 625 - protein, 56 aa, Homo sapiens
CNCSGRSEECTFDRELFRSTGHGGRCHHCRDHTAGPHCERCQENFYHWDPRMPCQP

SEQ ID NO: 626 - protein, 47 aa, Homo sapiens
CDCQSAGSLHLQCDDTGTCACKPTVTGWKCDRCLPGFHSLSEGGCRP

SEQ ID NO: 627 - protein, 50 aa, Homo sapiens
CTCNPAGSLDTCDPRSGRCPCKENVEGNLCDRCRPGTFNLQPHNPAGCSS

SEQ ID NO: 628 - protein, 48 aa, Homo sapiens
CTCNQHGTCDPNTGICVCSHHTEGPSCERCLPGFYGNPFAGQADDCQP

SEQ ID NO: 629 - protein, 55 aa, Homo sapiens
CPCPGQSACTTIPESREVVCTHCPPGQRGRRCEVCDDGFFGDPLGLFGHPQPCHQ

SEQ ID NO: 630 - protein, 56 aa, Homo sapiens
CQCSGNVDPNAVGNCDPLSGHCLRCLHNTTGDHCEHCQEGFYGSALAPRPADKCMP

SEQ ID NO: 631 - protein, 51 aa, Homo sapiens
CSCHPQGSVSEQMPCDPVTGQCSCLPHVTARDCSRCYPGFFDLQPGRGCRS

SEQ ID NO: 632 - protein, 48 aa, Homo sapiens
CKCHPLGSQEDQCHPKTGQCTCRPGVTGQACDRCQLGFFGFSIKGCRA

SEQ ID NO: 633 - protein, 33 aa, Homo sapiens
TKPSCVPPCQNGGMCLRPQLCVCKPGTKGKACE

SEQ ID NO: 634 - protein, 41 aa, Homo sapiens
DIDECQHRHLCAHGQCRNTEGSFQCVCDQGYRASGLGDHCE

SEQ ID NO: 635 - protein, 41 aa, Homo sapiens
DINECLEDKSVCQRGDCINTAGSYDCTCPDGFQLDDNKTCQ

SEQ ID NO: 636 - protein, 42 aa, Homo sapiens
DINECEHPGLCGPQGECLNTEGSFHCVCQQGFSISADGRTCE

SEQ ID NO: 637 - protein, 38 aa, Homo sapiens
DIDECVNNTVCDSHGFCDNTAGSFRCLCYQGFQAPQDG

SEQ ID NO: 638 - protein, 43 aa, Homo sapiens
DVNECELLSGVCGEAFCENVEGSFLCVCADENQEYSPMTGQCR

SEQ ID NO: 639 - protein, 43 aa, Homo sapiens
DADECLLFGQEICKNGFCLNTRPGYECYCKQGTYYDPVKLQCF

SEQ ID NO: 640 - protein, 37 aa, Homo sapiens
DMDECQDPSSCIDGQCVNTEGSYNCFCTHPMVLDASE

SEQ ID NO: 641 - protein, 37 aa, Homo sapiens
QAEECGILNGCENGRCVRVQEGYTCDCFDGYHLDTAK

SEQ ID NO: 642 - protein, 45 aa, Homo sapiens
DVNECDELNNRMSLCKNAKCINTDGSYKCLCLPGYVPSDKPNYCT

SEQ ID NO: 643 - protein, 33 aa, Homo sapiens
RVVICHLPCMNGGQCSSRDKCQCPPNFTGKLCQ

SEQ ID NO: 644 - protein, 38 aa, Homo sapiens
DINECQLQGVCPNGECLNTMGSYRCTCKIGFGPDPTFS

SEQ ID NO: 645 - protein, 38 aa, Homo sapiens
EINECTVNPDICGAGHCINLPVRYTCICYEGYRFSEQQ

SEQ ID NO: 646 - protein, 42 aa, Homo sapiens
DIDECTQVQHLCSQGRCENTEGSFLCICPAGFMASEEGTNCI

SEQ ID NO: 647 - protein, 41 aa, Homo sapiens
DVDECLRPDVCGEGHCVNTVGAFRCEYCDSGYRMTQRGRCE

SEQ ID NO: 648 - protein, 40 aa, Homo sapiens
DIDECLNPSTCPDEQCVNSPGSYQCVPCTEGFRGWNGQCL

SEQ ID NO: 649 - protein, 41 aa, Homo sapiens
DVDECLEPNVCANGDCSNLEGSYMCSCHKGYTRTPDHKHCR

SEQ ID NO: 650 - protein, 41 aa, Homo sapiens
DIDECQQGNLCVNGQCKNTEGSFRCTCGQGYQLSAAKDQCE

SEQ ID NO: 651 - protein, 33 aa, Homo sapiens
IKPVCEPPCQNRGSCSRPQLCVCRSGFRGARCE

SEQ ID NO: 652 - protein, 42 aa, Homo sapiens
DLDECAFPGVCPSGVCTNTAGSFSCKDCDGGYRPSPLGDSCE

SEQ ID NO: 653 - protein, 41 aa, Homo sapiens
DVDECEDPQSSCLGGECKNTVGSYQCLCPQGFQLANGTVCE

SEQ ID NO: 654 - protein, 42 aa, Homo sapiens
DVNECMGEEHCAPHGECLNSHGSFFCLCAPGFVSAEGGTSCQ

SEQ ID NO: 655 - protein, 41 aa, Homo sapiens
DVDECATTDPCVGGHCVNTEGSFNCLCETGFQPSPESGECV

SEQ ID NO: 656 - protein, 44 aa, Homo sapiens
DIDECEDYGDPVCGTWKCENSPGSYRCVLGCQPGFHMAPNGDCI

SEQ ID NO: 657 - protein, 42 aa, Homo sapiens
DIDECANDTMCGSHGFCDNTDGSFRCLCDQGFEISPSGWDCV

SEQ ID NO: 658 - protein, 43 aa, Homo sapiens
DVNECELMLAVCGAALCENVEGSFLCLCASDLEEYDAQEGHCR

SEQ ID NO: 659 - protein, 43 aa, Homo sapiens
DADECVIFGPGLCPNGRCLNTVPGYVCLCNPGFHYDASHKKCE

SEQ ID NO: 660 - protein, 40 aa, Homo sapiens
DHDECQDLACENGECVNTEGSFHCFCSPPLTLDLSQQRCM

SEQ ID NO: 661 - protein, 41 aa, Homo sapiens
QAEECGILNGCENGRCVRVREGYTCDCFEGFQLDAAHMACV

SEQ ID NO: 662 - protein, 33 aa, Homo sapiens
RIYFCQIPCLNGGRCIGRDECWCPANSTGKFCH

SEQ ID NO: 663 - protein, 45 aa, Homo sapiens
DVNECDDLNGPAVLCVHGYCENTEGSYRCHCSPGYVAEAGPPHCT

SEQ ID NO: 664 - protein, 41 aa, Homo sapiens
DINECLTLGLCKDAECVNTRGSYLCTCRPGLMLDPSRSRCV

SEQ ID NO: 665 - protein, 43 aa, Homo sapiens
GIDRCAAGATNVCGPGTCVNLPDGYRCVCSPGYQLHPSQAYCT

SEQ ID NO: 666 - protein, 43 aa, Homo sapiens
DDNECLRDPCKGKGRCINRVGSYSCFCYPGYTLATSGATQECQ

SEQ ID NO: 667 - protein, 40 aa, Homo sapiens
DINECEQPGVCSGGQCTNTEGSYHCECDQGYIMVRKGHCQ

SEQ ID NO: 668 - protein, 40 aa, Homo sapiens
DINECRHPGTCPDGRCVNSPGSYTCLACEEGYRGQSGSCV

SEQ ID NO: 669 - protein, 41 aa, Homo sapiens
DVNECLTPGVCAHGKCTNLEGSFRCSCEQGYEVTSDEKGCQ

SEQ ID NO: 670 - protein, 42 aa, Homo sapiens
DVDECASRASCPTGLCLNTEGSFACSACENGYWVNEDGTACE

SEQ ID NO: 671 - protein, 33 aa, Homo sapiens
RVVVCPLPCMNGGQCSSRNQCLCPPDFTGRFCQ

SEQ ID NO: 672 - protein, 43 aa, Homo sapiens
DIDECMLFGSEICKEGKCVNTQPGYECYCKQGFYYDGNLLECV

SEQ ID NO: 673 - protein, 41 aa, Homo sapiens
DVDECLDESNCRNGVCENTRGGYRCACTPPAEYSPAQRQCL

SEQ ID NO: 674 - protein, 41 aa, Homo sapiens
DVDECQDPAACRPGRCVNLPGSYRCECRPPWVPGPSGRDCQ

SEQ ID NO: 675 - protein, 45 aa, Homo sapiens
DIDECRELNQRGLLCKSERCVNTSGSFRCVCKAGFARSRPHGACV

SEQ ID NO: 676 - protein, 41 aa, Homo sapiens
DINECAMPGVCRHGDCLNNPGSYRCVCPPGHSLGPSRTQCI

SEQ ID NO: 677 - protein, 42 aa, Homo sapiens
ETDECRLNQNICGHGECVPGPPDYSCHCNPGYRSHPQHRYCV

SEQ ID NO: 678 - protein, 44 aa, Homo sapiens
DVNECEAEPCGPGRGICMNTGGSYNCHCNRGYRLHVGAGGRSCV

SEQ ID NO: 679 - protein, 43 aa, Homo sapiens
DLNECAKPHLCGDGGFCINFPGHYKCNCYPGYRLKASRPPVCE

SEQ ID NO: 680 - protein, 41 aa, Homo sapiens
DVNECAEGSPCSPGWCENLPGSFRCTCAQGYAPAPDGRSCL

SEQ ID NO: 681 - protein, 41 aa, Homo sapiens
DVDECEAGDVCDNGICSNTPGSFQCQCLSGYHLSRDRSHCE

SEQ ID NO: 682 - protein, 40 aa, Homo sapiens
DIDECDFPAACIGGDCINTNGSYRCLCPQGHRLVGGRKCQ

SEQ ID NO: 683 - protein, 43 aa, Homo sapiens
DIDECSQDPSLCLPHGACKNLQGSYVCVCDEGFTPTQDQHGCE

SEQ ID NO: 684 - protein, 33 aa, Homo sapiens
APVLCPLICHNGGVCVKPDRCLCPPDFAGKFCQ

SEQ ID NO: 685 - protein, 42 aa, Homo sapiens
DVNECLEGDFCFPHGECLNTDGSFACTCAPGYRPGPRGASCL

SEQ ID NO: 686 - protein, 41 aa, Homo sapiens
DVDECSEEDLCQSGICTNTDGSFECICPPGHRAGPDLASCL

SEQ ID NO: 687 - protein, 42 aa, Homo sapiens
DVDECRNRSFCGAHAVCQNLPGSFQCLCDQGYEGARDGRHCV

SEQ ID NO: 688 - protein, 43 aa, Homo sapiens
DVDECQLFRDQVCKSGVCVNTAPGYSCYCSNGYYYHTQRLECI

SEQ ID NO: 689 - protein, 42 aa, Homo sapiens
DNDECADEEPACEGGRCVNTVGSYHCTCEPPLVLDGSQRRCV

SEQ ID NO: 690 - protein, 41 aa, Homo sapiens
EAEECGILDGCTNGRCVRVPEGFTCRCFDGYRLDMTRMACV

SEQ ID NO: 691 - protein, 45 aa, Homo sapiens
DINECDEAEAASPLCVNARCLNTDGSFRCICRPGFAPTHQPHHCA

SEQ ID NO: 692 - protein, 41 aa, Homo sapiens
DVDECATGGRCQHGECANTRGGYTCVCPDGFLLDSSRSSCI

SEQ ID NO: 693 - protein, 42 aa, Homo sapiens
SSGMCQRNPQVCGPGRCISRPSGYTCACDSGFRLSPQGTRCI

SEQ ID NO: 694 - protein, 42 aa, Homo sapiens
DVDECRRVPPPCAPGRCENSPGSFRCVCGPGFRAGPRAAECL

SEQ ID NO: 695 - protein, 42 aa, Homo sapiens
DVDECHRVPPPCDLGRCENTPGSFLCVCPAGYQAAPHGASCQ

SEQ ID NO: 696 - protein, 38 aa, Homo sapiens
DVDECTQSPGLCGRGACKNLPGSFRCVCPAGFRGSACE

SEQ ID NO: 697 - protein, 42 aa, Homo sapiens
DVDECAQEPPPCGPGRCDNTAGSFHCACPAGFRSRGPGAPCQ

SEQ ID NO: 698 - protein, 42 aa, Homo sapiens
DVDECARSPPPCTYGRCENTEGSFQCVCPMGFQPNTAGSECE

SEQ ID NO: 699 - protein, 44 aa, Homo sapiens
DVDECSSGAPPCGPHGHCTNTEGSFRCSCAPGYRAPSGRPGPCA

SEQ ID NO: 700 - protein, 40 aa, Homo sapiens
GTNECLDNNGGCSHVCNDLKIGYECLCPDGFQLVAQRRCE

SEQ ID NO: 701 - protein, 40 aa, Homo sapiens
DIDECQDPDTCSQLCVNLEGGYKCQCEEGFQLDPHTKACK

SEQ ID NO: 702 - protein, 50 aa, Homo sapiens
GVNWCERTTLSNGGCQYLCLPAPQINPHSPKFTCACPDGMLLARDMRSCL

SEQ ID NO: 703 - protein, 36 aa, Homo sapiens
NCSRLGCQHHCVPTLDGPTCYCNSSFQLQADGKTCK

SEQ ID NO: 704 - protein, 39 aa, Homo sapiens
LLSNCQQLNCQYKCTMVRNSTRCYCEDGFEITEDGRSCK

SEQ ID NO: 705 - protein, 34 aa, Homo sapiens
LDDSCKLTCENGGRCILNEKGDLRCHCWPSYSGE

SEQ ID NO: 706 - protein, 37 aa, Homo sapiens
EVNHCSNYCQNGGTCVPSVLGRPTCSCALGFTGPNCG

SEQ ID NO: 707 - protein, 37 aa, Homo sapiens
GKTVCEDFCQNGGTCIVTAGNQPYCHCQPEYTGDRCQ

SEQ ID NO: 708 - protein, 37 aa, Homo sapiens
QYYVCHHYCVNSESCTIGDDGSVECVCPTRYEGPKCE

SEQ ID NO: 709 - protein, 38 aa, Homo sapiens
SCQLCDGYCYNGGTCQLDPETNVPVCLCSTNWSGTQCE

SEQ ID NO: 710 - protein, 40 aa, Homo sapiens
DQDECAVYGTCSQTCRNTHGSYTCSCVEGYLMQPDNRSCK

SEQ ID NO: 711 - protein, 41 aa, Homo sapiens
GDNMCRVNNGGCSTLCLAIPGGRVCACADNQLLDENGTTCT

SEQ ID NO: 712 - protein, 42 aa, Homo sapiens
GSNSCQLNNGGCSQLCLPTSETTRTCMCTVGYYLQKNRMSCQ

SEQ ID NO: 713 - protein, 41 aa, Homo sapiens
GTNVCARDNGGCKQLCLYRGNSRRTCACAHGYLAEDGVTCL

SEQ ID NO: 714 - protein, 42 aa, Homo sapiens
HINECLSKKVSGCSQDCQDLPVSYKCKCWPGFQLKDDGKTCV

SEQ ID NO: 715 - protein, 41 aa, Homo sapiens
DIDECSSGFPCSQQCINTYGTYKCLCTDGYEIQPDNPNGCK

SEQ ID NO: 716 - protein, 43 aa, Homo sapiens
TEYTCEDNVNPCGDDAYCNQIKTSVFCRCKPGFQRNMKNRQCE

SEQ ID NO: 717 - protein, 38 aa, Homo sapiens
DLNECLVFGTCSHQCINVEGSYKCVCDQNFQERNNTCI

SEQ ID NO: 718 - protein, 39 aa, Homo sapiens
MTLCSALNCQYQCHETPYGGACFCPPGYIINHNDSRTCV

SEQ ID NO: 719 - protein, 43 aa, Homo sapiens
CNNPCEQFNGGCSHICAPGPNGAECQCPHEGNWYLANNRKHCI

SEQ ID NO: 720 - protein, 41 aa, Homo sapiens
INECHDPSISGCDHNCTDTLTSFYCSCRPGYKLMSDKRTCV

SEQ ID NO: 721 - protein, 41 aa, Homo sapiens
DIDECTEMPFVCSQKCENVIGSYICKCAPGYLREPDGKTCR

SEQ ID NO: 722 - protein, 45 aa, Homo sapiens
VSNPCGTNNGGCSHLCLIKPGGKGFTCECPDDFRTLQLSGSTYCM

SEQ ID NO: 723 - protein, 41 aa, Homo sapiens
KERTCAENICEQNCTQLNEGGFICSCTAGFETNVFDRTSCL

SEQ ID NO: 724 - protein, 42 aa, Homo sapiens
DINECEQFGTCPQHCRNTKGSYECVCADGFTSMSDRPGKRCA

SEQ ID NO: 725 - protein, 39 aa, Homo sapiens
VPNLCKQICSHLCLLRPGGYSCACPQGSSFIEGSTTECD

SEQ ID NO: 726 - protein, 35 aa, Homo sapiens
LPPPCRCMHGGNCYFDETDLPKCKCPSGYTGKYCE

SEQ ID NO: 727 - protein, 39 aa, Homo sapiens
EFDDCQIWGICDQKCESRPGRHLCHCEEGYILERGQYCK

SEQ ID NO: 728 - protein, 47 aa, Homo sapiens
ATNPCKDNNGGCEQVCVLSHRTDNDGLGFRCKCTFGFQLDTDERHCI

SEQ ID NO: 729 - protein, 45 aa, Homo sapiens
GSNACNQPTHPNGDCSHFCFPVPNFQRVCGCPYGMRLASNHLTCE

SEQ ID NO: 730 - protein, 41 aa, Homo sapiens
NGNSCSDFNGGCTHECVQEPFGAKCLCPLGFLLANDSKTCE

SEQ ID NO: 731 - protein, 40 aa, Homo sapiens
DIDECDILGSCSQHCYNMRGSFRCSCDTGYMLESDGRTCK

SEQ ID NO: 732 - protein, 42 aa, Homo sapiens
SVNPCAFSRCSHLCLLSSQGPHFYSCVCPSGWSLSPDLLNCL

SEQ ID NO: 733 - protein, 42 aa, Homo sapiens
SSNGCSNNMNACQQICLPVPGGLFSCACATGFKLNPDNRSCS

SEQ ID NO: 734 - protein, 42 aa, Homo sapiens
NNNPCLENNGGCSHLCFALPGLHTPKCDCAFGTLQSDGKNCA

SEQ ID NO: 735 - protein, 41 aa, Homo sapiens
GEENCNVNNGGCAQKCQMVRGAVQCTCHTGYRLTEDGHTCQ

SEQ ID NO: 736 - protein, 40 aa, Homo sapiens
DVNECAEEGYCSQGCTNSEGAFQCWCETGYELRPDRRSCK

SEQ ID NO: 737 - protein, 40 aa, Homo sapiens
GKNRCGDNNGGCTHLCLPSGQNYTCACPTGFRKISSHACA

SEQ ID NO: 738 - protein, 43 aa, Homo sapiens
FHTRCEEDNGGCSHLCLLSPSEPFYTCACPTGVQLQDNGRTCK

SEQ ID NO: 739 - protein, 41 aa, Homo sapiens
GTNPCADRNGGCSHLCFFTPHATRCGCPIGLELLSDMKTCI

SEQ ID NO: 740 - protein, 41 aa, Homo sapiens
GLNDCMHNNGQCGQLCLAIPGGHRCGCASHYTLDPSSRNCS

SEQ ID NO: 741 - protein, 42 aa, Homo sapiens
SAHPCARDNGGCSHICIAKGDGTPRCSCPVHLVLLQNLLTCG

SEQ ID NO: 742 - protein, 43 aa, Homo sapiens
ATNPCGIDNGGCSHLCLMSPVKPFYQCACPTGVKLLENGKTCK

SEQ ID NO: 743 - protein, 41 aa, Homo sapiens
GSNPCAEENGGCSHLCLYRPQGLRCACPIGFELISDMKTCI

SEQ ID NO: 744 - protein, 42 aa, Homo sapiens
GWNECASSNGHCSHLCLAVPVGGFVCGCPAHYSLNADNRTCS

SEQ ID NO: 745 - protein, 42 aa, Homo sapiens
RQHPCAQDNGGCSHICLVKGDGTTRCSCPMHLVLLQDELSCG

SEQ ID NO: 746 - protein, 40 aa, Homo sapiens
GLNECLHNNGGCSHICTDLKIGFECTCPAGFQLLDQKTCG

SEQ ID NO: 747 - protein, 40 aa, Homo sapiens
DIDECKDPDACSQICVNYKGYFKCECYPGYEMDLLTKNCK

SEQ ID NO: 748 - protein, 37 aa, Homo sapiens
YTASCQPWSCSGHGECVEIINNYTCNCDVGYYGPQCQ

SEQ ID NO: 749 - protein, 44 aa, Homo sapiens
DVDECKEREDEELSCDHYCHNYIGGYYCSCRFGYILHTDNRTCR

SEQ ID NO: 750 - protein, 44 aa, Homo sapiens
DIDECQVAPGEAPTCDHHCHNHLGGFYCSCRAGYVLHRNKRTCS

SEQ ID NO: 751 - protein, 38 aa, Homo sapiens
LCATGDHDCEQVCISSPGSYTCACHEGFTLNSDGKTCN

SEQ ID NO: 752 - protein, 41 aa, Homo sapiens
TAHMCSTLEHNCAHFCINIPGSYVCRCKQGYILNSDQTTCR

SEQ ID NO: 753 - protein, 41 aa, Homo sapiens
RKDVCKSTHHGCEHICVNNGNSYICKCSEGFVLAEDGRRCK

SEQ ID NO: 754 - protein, 41 aa, Homo sapiens
IQDLCAMEDHNCEQLCVNVPGSFVCQCYSGYALAEDGKRCV

SEQ ID NO: 755 - protein, 41 aa, Homo sapiens
AVDYCASENHGCEHECVNADGSYLCQCHEGFALNPDKKTCT

SEQ ID NO: 756 - protein, 41 aa, Homo sapiens
KIDYCASSNHGCQHECVNTDDSYSCHCLKGFTLNPDKKTCR

SEQ ID NO: 757 - protein, 41 aa, Homo sapiens
RINYCALNKPGCEHECVNMEESYYCRCHRGYTLDPNGKTCS

SEQ ID NO: 758 - protein, 41 aa, Homo sapiens
RVDHCAQQDHGCEQLCLNTEDSFVCQCSEGFLINEDLKTCS

SEQ ID NO: 759 - protein, 41 aa, Homo sapiens
RVDYCLLSDHGCEYSCVNMDRSFACQCPEGHVLRSDGKTCA

SEQ ID NO: 760 - protein, 41 aa, Homo sapiens
KLDSCALGDHGCEHSCVSSEDSFVCQCFEGYILREDGKTCR

SEQ ID NO: 761 - protein, 41 aa, Homo sapiens
RKDVCQAIDHGCEHICVNSDDSYTCECLEGFRLAEDGKRCR

SEQ ID NO: 762 - protein, 42 aa, Homo sapiens
ALDPCVLGTHQCQHVCISDGEGKHHCECSQGYTLNADKKTCS

SEQ ID NO: 763 - protein, 42 aa, Homo sapiens
ALDRCALNTHGCEHICVNDRSGSYHCECYEGYTLNEDRKTCS

SEQ ID NO: 764 - protein, 42 aa, Homo sapiens
AQDKCALGTHGCQHICVNDRTGSHHCECYEGYTLNADKKTCS

SEQ ID NO: 765 - protein, 42 aa, Homo sapiens
VRDKCALGSHGCQHICVSDGAASYHCDCYPGYTLNEDKKTCS

SEQ ID NO: 766 - protein, 41 aa, Homo sapiens
GKDQCAEGGHGCQHQCVNAWAMFHCTCNPGYKLAADNKSCL

SEQ ID NO: 767 - protein, 37 aa, Homo sapiens
AIDLCAEGTHGCEHHCVNSPGSYFCHCQVGFVLQQDQ

SEQ ID NO: 768 - protein, 41 aa, Homo sapiens
AIDYCSFGNHSCQHECVSTPGGPRCHCREGHDLQPDGRSCQ

SEQ ID NO: 769 - protein, 36 aa, Homo sapiens
CNGVDHGCEFQCVSEGLSYRCLCPEGRQLQADGKSC

SEQ ID NO: 770 - protein, 41 aa, Homo sapiens
FRDPCDPNPCQNDGICVNVKGMASCRCISGHAFFYTGERCQ

SEQ ID NO: 771 - protein, 41 aa, Homo sapiens
VQDLCSKTTCKNDGVCTVRDGKAECRCQSGEDWWYMGERCE

SEQ ID NO: 772 - protein, 39 aa, Homo sapiens
TIVSTESLETLAPGLCQEGQIWNGKQCVCPQGYVGYQCL

SEQ ID NO: 773 - protein, 39 aa, Homo sapiens
PSNPCQDDPCADNSLCVKLHNTSFCLCLEGYYYNSSTCK

SEQ ID NO: 774 - protein, 40 aa, Homo sapiens
LTLRCDYYGCNQTADDCLNGLACDCKSDLQRPNPQSPFCV

SEQ ID NO: 775 - protein, 42 aa, Homo sapiens
SSLKCPDACNAQHKQCLIKKSGGAPECACVPGYQEDANGNCQ

SEQ ID NO: 776 - protein, 40 aa, Homo sapiens
RTTTCFGDGCQNTASRCKNGGTWDGLKCQCPNLYYGELCE

SEQ ID NO: 777 - protein, 34 aa, Homo sapiens
SGDRCQLQTRCQNGGQWDGLKCQCPSTFYGSSCE

SEQ ID NO: 778 - protein, 40 aa, Homo sapiens
QNQSCPVNYCYNQGHCYISQTLGCQPMCTCPPAFTDSRCF

SEQ ID NO: 779 - protein, 40 aa, Homo sapiens
VSPCSRGYCDHGGQCQHLPSGPRCSCVSFSIYTAWGEHCE

SEQ ID NO: 780 - protein, 37 aa, Homo sapiens
EYSSCSRHPCQNGGTCINGRTSFTCACRHPFTGDNCT

SEQ ID NO: 781 - protein, 31 aa, Homo sapiens
VPHCADKCVHGRCIAPNTCQCEPGWGGTNCS

SEQ ID NO: 782 - protein, 31 aa, Homo sapiens
AERCDCSHADGCHPTTGHCRCLPGWSGVHCD

SEQ ID NO: 783 - protein, 36 aa, Homo sapiens
WGPNCSLPCYCKNGASCSPDDGICECAPGFRGTTCQ

SEQ ID NO: 784 - protein, 36 aa, Homo sapiens
FGKNCAGICTCTNNGTCNPIDRSCQCYPGWIGSDCS

SEQ ID NO: 785 - protein, 31 aa, Homo sapiens
IHTCNCHNGAFCSAYDGECKCTPGWTGLYCT

SEQ ID NO: 786 - protein, 36 aa, Homo sapiens
YGKDCALICQCQNGADCDHISGQCTCRTGFMGRHCE

SEQ ID NO: 787 - protein, 31 aa, Homo sapiens
RQICDCLNNSTCDHITGTCYCSPGWKGARCD

SEQ ID NO: 788 - protein, 36 aa, Homo sapiens
WGPHCTSRCQCKNGALCNPITGACHCAAGFRGWRCE

SEQ ID NO: 789 - protein, 36 aa, Homo sapiens
YGNDCHQRCQCQNGATCDHVTGECRCPPGYTGAFCE

SEQ ID NO: 790 - protein, 36 aa, Homo sapiens
HGPQCEQRCPCQNGGVCHHVTGECSCPSGWMGTVCG

SEQ ID NO: 791 - protein, 31 aa, Homo sapiens
SQECQCHNGGTCDAATGQCHCSPGYTGERCQ

SEQ ID NO: 792 - protein, 36 aa, Homo sapiens
YGVLCAETCQCVNGGKCYHVSGACLCEAGFAGERCE

SEQ ID NO: 793 - protein, 36 aa, Homo sapiens
YGEACQQICSCQNGADCDSVTGKCTCAPGFKGIDCS

SEQ ID NO: 794 - protein, 31 aa, Homo sapiens
SSRCGCKNDAVCSPVDGSCTCKAGWHGVDCS

SEQ ID NO: 795 - protein, 36 aa, Homo sapiens
WGFGCNLTCQCLNGGACNTLDGTCTCAPGWRGEKCE

SEQ ID NO: 796 - protein, 36 aa, Homo sapiens
SGDFCIPLCTEECVHGRCVSPDTCHCEPGWGGPDCS

SEQ ID NO: 797 - protein, 36 aa, Homo sapiens
WGPNCSVSCSCENGGSCSPEDGSCECAPGFRGPLCQ

SEQ ID NO: 798 - protein, 36 aa, Homo sapiens
FGQDCAQLCSCANNGTCSPIDGSCQCFPGWIGKDCS

SEQ ID NO: 799 - protein, 31 aa, Homo sapiens
FHACSCHNGASCSAEDGACHCTPGWTGLFCT

SEQ ID NO: 800 - protein, 31 aa, Homo sapiens
GRVCQCQNGASCDHISGKCTCRTGFTGQHCE

SEQ ID NO: 801 - protein, 36 aa, Homo sapiens
FGYGCQQLCECMNNSTCDHVTGTCYCSPGFKGIRCD

SEQ ID NO: 802 - protein, 31 aa, Homo sapiens
SNRCQCQNGALCNPITGACVCAAGFRGWRCE

SEQ ID NO: 803 - protein, 36 aa, Homo sapiens
HGKGCQLPCQCRHGASCDPRAGECLCAPGYTGVYCE

SEQ ID NO: 804 - protein, 36 aa, Homo sapiens
HGAHCELRCPCQNGGTCHHITGECACPPGWTGAVCA

SEQ ID NO: 805 - protein, 36 aa, Homo sapiens
FGQNCSQDCPCHHGGQCDHVTGQCHCTAGYMGDRCQ

SEQ ID NO: 806 - protein, 36 aa, Homo sapiens
FGFQCSQHCDCHNGGQCSPTTGACECEPGYKGPRCQ

SEQ ID NO: 807 - protein, 36 aa, Homo sapiens
YGDGCQLPCTCQNGADCHSITGGCTCAPGFMGEVCA

SEQ ID NO: 808 - protein, 36 aa, Homo sapiens
YGPNCSSICSCNNGGTCSPVDGSCTCKEGWQGLDCT

SEQ ID NO: 809 - protein, 31 aa, Homo sapiens
NESCTCANGAACSPIDGSCSCTPGWLGDTCE

SEQ ID NO: 810 - protein, 36 aa, Homo sapiens
LSAECSASLCFHGGRCVPGSAQPCHCPPGFQGPRCQ

SEQ ID NO: 811 - protein, 36 aa, Homo sapiens
FGKNCSFSCSCQNGGTCDSVTGACRCPPGVSGTNCE

SEQ ID NO: 812 - protein, 36 aa, Homo sapiens
YGKHCRKKCNCANRGRCHRLYGACLCDPGLYGRFCH

SEQ ID NO: 813 - protein, 35 aa, Homo sapiens
FGVNCSSSCSCGGAPCHGVTGQCRCPPGRTGEDCE

SEQ ID NO: 814 - protein, 32 aa, Homo sapiens
QEICPACQHAARCDPETGACLCLPGFVGSRCQ

SEQ ID NO: 815 - protein, 36 aa, Homo sapiens
YGPSCQTRCSCANDGHCHPATGHCSCAPGWTGFSCQ

SEQ ID NO: 816 - protein, 37 aa, Homo sapiens
WGPDCSHPCNCSAGHGSCDAISGLCLCEAGYVGPRCE

SEQ ID NO: 817 - protein, 36 aa, Homo sapiens
FGPGCEQRCQCQHGAACDHVSGACTCPAGWRGTFCE

SEQ ID NO: 818 - protein, 33 aa, Homo sapiens
DCRSACNCTAGAACDAVNGSCLCPAGRRGPRCA

SEQ ID NO: 819 - protein, 36 aa, Homo sapiens
YGHNCSQACACFNGASCDPVHGQCHCAPGWMGPSCL

SEQ ID NO: 820 - protein, 36 aa, Homo sapiens
YGDNCRHSCLCQNGGTCDPVSGHCACPEGWAGLACE

SEQ ID NO: 821 - protein, 41 aa, Homo sapiens
DVDECRTHNGGCQHRCVNTPGSYLCECKPGFRLHTDSRTCL

SEQ ID NO: 822 - protein, 36 aa, Homo sapiens
VRAGCRHSGGCLNGGLCDPHTGRCLCPAGWTGDKCQ

SEQ ID NO: 823 - protein, 36 aa, Homo sapiens
FGEACAQRCSCPPGAACHHVTGACRCPPGFTGSGCE

SEQ ID NO: 824 - protein, 36 aa, Homo sapiens
YGPGCEQLCGCLNGGSCDAATGACRCPTGFLGTDCN

SEQ ID NO: 825 - protein, 36 aa, Homo sapiens
FGPNCTHVCGCGQGAACDPVTGTCLCPPGRAGVRCE

SEQ ID NO: 826 - protein, 36 aa, Homo sapiens
FGVGCEHTCSCRNGGLCHASNGSCSCGLGWTGRHCE

SEQ ID NO: 827 - protein, 31 aa, Homo sapiens
HLECSCHNNSTCEPATGTCRCGPGFYGQACE

SEQ ID NO: 828 - protein, 36 aa, Homo sapiens
HGAGCQGLCWCQHGAPCDPISGRCLCPAGFHGHFCE

SEQ ID NO: 829 - protein, 36 aa, Homo sapiens
FGPSCTLHCDCGGGADCDPVSGQCHCVDGYMGPTCR

SEQ ID NO: 830 - protein, 37 aa, Homo sapiens
CALGNGGCQHHCVQLTITRHRCQCRPGFQLQEDGRHC

SEQ ID NO: 831 - protein, 47 aa, Homo sapiens
DGRHCVRRSPCANRNGSCMHRCQVVRGLARCECHVGYQLAADGKACE

SEQ ID NO: 832 - protein, 41 aa, Homo sapiens
DVDECAAGLAQCAHGCLNTQGSFKCVCHAGYELGADGRQCY

SEQ ID NO: 833 - protein, 36 aa, Homo sapiens
CEANNGGCSHGCSHTSAGPLCTCPRGYELDTDQRTC

SEQ ID NO: 834 - protein, 37 aa, Homo sapiens
DCADSPCCQQVCTNNPGGYECGCYAGYRLSADGCGCE

SEQ ID NO: 835 - protein, 41 aa, Homo sapiens
DVDECASSRGGCEHHCTNLAGSFQCSCEAGYRLHEDRRGCS

SEQ ID NO: 836 - protein, 37 aa, Homo sapiens
FGHDCSLTCDDCRNGGTCLLGLDGCDCPEGWTGLICN

SEQ ID NO: 837 - protein, 31 aa, Homo sapiens
RFSLCPGGCQSHGQCQPPGVCACEPGWGGPD

SEQ ID NO: 838 - protein, 34 aa, Homo sapiens
GLQECSAYCGSHGTCASPLGPCRCEPGFLGRACD

SEQ ID NO: 839 - protein, 42 aa, Homo sapiens
DVDECRLGLARCHPRATCLNTPLSYECHCQRGYQGDGISHCN

SEQ ID NO: 840 - protein, 43 aa, Homo sapiens
GSARCGSGGPGSCPVPQECVPQDGAAGAGLCRCPQGWAGPHCR

SEQ ID NO: 841 - protein, 39 aa, Homo sapiens
PEDECANGHHDCNETQNCHDQPHGYECSCKTGYTMDNMT

SEQ ID NO: 842 - protein, 48 aa, Homo sapiens
CGCSFHSHCRKRGPGFCDECQDWTWGEHCERCRPGSFGNATGSRGCRP

SEQ ID NO: 843 - protein, 51 aa, Homo sapiens
CQCNGHGDPRRGHCDNLSGLCFCQDHTEGAHCQLCSPGYYGDPRAGGSCFR

SEQ ID NO: 844 - protein, 49 aa, Homo sapiens
CRCNRHSECAGVGARDHCLLCRNHTKGSHCEQCLPLFVGSAVGGGTCRP

SEQ ID NO: 845 - protein, 64 aa, Homo sapiens
CQCNGHADTCNEQDGTGCPCQNNTETGTCQGSSPSDRRDCYKYQCAKCRESFHGSPLGGQQCYR

SEQ ID NO: 846 - protein, 50 aa, Homo sapiens
CNCSVVGSLNVNRCNQTTGQCECRPGYQGLHCETCKEGFYLNYTSGLCQP

SEQ ID NO: 847 - protein, 47 aa, Homo sapiens
CDCSPHGALSIPCNSSGKCQCKVGVIGSICDRCQDGYYGFSKNGCLP

SEQ ID NO: 848 - protein, 48 aa, Homo sapiens
CQCNNRSASCDALTGACLNCQENSKGNHCEECKEGFYQSPDATKECLR

SEQ ID NO: 849 - protein, 51 aa, Homo sapiens
CPCSAVTSTGSCSIKSSELEPECDQCKDGYIGPNCNKCENGYYNFDSICRK

SEQ ID NO: 850 - protein, 52 aa, Homo sapiens
CQCHGHVDPVKTPKICKPESGECINCLHNTTGFWCENCLEGYVHDLEGNCIK

SEQ ID NO: 851 - protein, 33 aa, Homo sapiens
DELDCGPSNCSQHGLCTETGCRCDAGWTGSNCS

SEQ ID NO: 852 - protein, 36 aa, Homo sapiens
SWGQCQPVCQPRCKHGECIGPNKCKCHPGYAGKTCN

SEQ ID NO: 853 - protein, 40 aa, Homo sapiens
DLNECGLKPRPCKHRCMNTYGSYKCYCLNGYMLMPDGSCS

SEQ ID NO: 854 - protein, 37 aa, Homo sapiens
TCSMANCQYGCDVVKGQIRCQCPSPGLQLAPDGRTCV

SEQ ID NO: 855 - protein, 45 aa, Homo sapiens
DVDECATGRASCPRFRQCVNTFGSYICKCHKGFDLMYIGGKYQCH

SEQ ID NO: 856 - protein, 41 aa, Homo sapiens
DIDECSLGQYQCSSFARCYNIRGSYKCKCKEGYQGDGLTCV

SEQ ID NO: 857 - protein, 56 aa, Homo sapiens
CKCNGHAARCVRDRDDSLVCDCRHNTAGPECDRCKPFHYDRPWQRATAREANECVA

SEQ ID NO: 858 - protein, 63 aa, Homo sapiens
CNCNLHARRCRFNMELYKLSGRKSGGVCLNCRHNTAGRHCHYCKEGYYRDMGKPITHRKACKA

SEQ ID NO: 859 - protein, 50 aa, Homo sapiens
CDCHPVGAAGKTCNQTTGQCPCKDGVTGITCNRCAKGYQQSRSPIAPCIK

SEQ ID NO: 860 - protein, 54 aa, Homo sapiens
CKCNGHASRCLLDTQGHLICDCRHGTEGPDCGRCKPFYCDRPWQRATARESHAC

SEQ ID NO: 861 - protein, 61 aa, Homo sapiens
CSCNGHARRCRFNMELYRLSGRRSGGVCLNCRHNTAGRHCHYCREGFYRDPGRALSDRRAC

SEQ ID NO: 862 - protein, 48 aa, Homo sapiens
CDCHPVGAAGKTCNQTTGQCPCKDGVTGLTCNRCAPGFQQSRSPVAPC

SEQ ID NO: 863 - protein, 70 aa, Homo sapiens
CFCNGHADQCIPVHGFRPVKAPGTFHMVHGKCMCKHNTAGSHCQHCAPLYNDRPWEAADGKTGAPNECRT

SEQ ID NO: 864 - protein, 63 aa, Homo sapiens
CKCNGHADTCHFDVNVWEASGNRSGGVCDDCQHNTEGQYCQRCKPGFYRDLRRPFSAPDACKP

SEQ ID NO: 865 - protein, 54 aa, Homo sapiens
CSCHPVGSAVLPANSVTFCDPSNGDCPCKPGVAGRRCDRCMVGYWGFGDYGCRP

SEQ ID NO: 866 - protein, 55 aa, Homo sapiens
CQCHGHAARCAARARPPRCHCRHHTTGPGCESCRPSHRDWPWRPATPRHPHPCLP

SEQ ID NO: 867 - protein, 63 aa, Homo sapiens
CSCNQHARRCRFNSELFRLSGGRSGGVCERCRHHTAGRHCHYCQPGFWRDPSQPIFSRRACRA

SEQ ID NO: 868 - protein, 50 aa, Homo sapiens
CQCHPIGATGGTCNQTSGQCTCKLGVTGLTCNRCGPGYQQSRSPRMPCQR

SEQ ID NO: 869 - protein, 60 aa, Homo sapiens
CKCNLHATVCVYDNSKLTCECEHNTTGPDCGKCKKNYQGRPWSPGSYLPIPKGTANTCIP

SEQ ID NO: 870 - protein, 56 aa, Homo sapiens
CECFGHSNRCSYIDLLNTVICVSCKHNTRGQHCELCRLGYFRNASAQLDDENVCIE

SEQ ID NO: 871 - protein, 50 aa, Homo sapiens
CYCNPLGSIHDRCNGSGFCECKTGTTGPKCDECLPGNSWHYGCQPNVCDN

SEQ ID NO: 872 - protein, 60 aa, Homo sapiens
CKCNLHANLCSMREGSLQCECEHNTTGPDCGKCKKNFRTRSWRAGSYLPLPHGSPNACAT

SEQ ID NO: 873 - protein, 56 aa, Homo sapiens
CECYGHSNRCSYIDFLNVVTCVSCKHNTRGQHCQHCRLGYYRNGSAELDDENVCIE

SEQ ID NO: 874 - protein, 45 aa, Homo sapiens
CNCNQIGSVHDRCNETGFCECREGAAGPKCDDCLPTHYWRQGCYP

SEQ ID NO: 875 - protein, 44 aa, Homo sapiens
GGSPCEAGEEGEGGVCLNGGVCSVVDDQAVCDCSRTGFRGKDCS

SEQ ID NO: 876 - protein, 38 aa, Homo sapiens
TAKPCLSNPCKNNGMCRDGWNRYVCDCSGTGYLGRSCE

SEQ ID NO: 877 - protein, 38 aa, Homo sapiens
PSTTCQEDSCSNQGVCLQQWDGFSCDCSMTSFSGPLCN

SEQ ID NO: 878 - protein, 41 aa, Homo sapiens
ADPLCAPARNPCANGGLCTVLAPGEVGCDCSHTGFGGKFCS

SEQ ID NO: 879 - protein, 38 aa, Homo sapiens
TLKQCASAPCRNGGVCREGWNRFICDCIGTGFLGRVCE

SEQ ID NO: 880 - protein, 38 aa, Homo sapiens
PSTTCTEESCANQGVCLQQWDGFTCDCTMTSYGGPVCN

SEQ ID NO: 881 - protein, 38 aa, Homo sapiens
AEGPCGERPCENGGICFLLDGHPTCDCSTTGYGGKLCS

SEQ ID NO: 882 - protein, 38 aa, Homo sapiens
SAKQCDSYPCKNNAVCKDGWNRFICDCTGTGYWGRTCE

SEQ ID NO: 883 - protein, 38 aa, Homo sapiens
PSTTCQEDSCANQGVCMQQWEGFTCDCSMTSYSGNQCN

SEQ ID NO: 884 - protein, 37 aa, Homo sapiens
HSDPCENNPCLHGGTCNANGTMYGCSCDQGFAGENCE

SEQ ID NO: 885 - protein, 37 aa, Homo sapiens
DIDDCLCSPCENGGTCIDEVNGFVCLCLPSYGGSFCE

SEQ ID NO: 886 - protein, 39 aa, Homo sapiens
RGPRCSQPGETCLNGGKCEAANGTEACVCGGAFVGPRCQ

SEQ ID NO: 887 - protein, 39 aa, Homo sapiens
LNDACISNPCNEGSNCDTNPVNGKAICTCPSGYTGPACS

SEQ ID NO: 888 - protein, 39 aa, Homo sapiens
DVDECSLGANPCEHAGKCINTLGSFECQCLQGYTGPRCE

SEQ ID NO: 889 - protein, 37 aa, Homo sapiens
DVNECVSNPCQNDATCLDQIGEFQCICMPGYEGVHCE

SEQ ID NO: 890 - protein, 37 aa, Homo sapiens
NTDECASSPCLHNGRCLDKINEFQCECPTGFTGHLCQ

SEQ ID NO: 891 - protein, 37 aa, Homo sapiens
DVDECASTPCKNGAKCLDGPNTYTCVCTEGYTGTHCE

SEQ ID NO: 892 - protein, 36 aa, Homo sapiens
DIDECDPDPCHYGSCKDGVATFTCLCRPGYTGHHCE

SEQ ID NO: 893 - protein, 37 aa, Homo sapiens
NINECSSQPCRHGGTCQDRDNAYLCFCLKGTTGPNCE

SEQ ID NO: 894 - protein, 36 aa, Homo sapiens
NLDDCASSPCDSGTCLDKIDGYECACEPGYTGSMCN

SEQ ID NO: 895 - protein, 37 aa, Homo sapiens
NIDECAGNPCHNGGTCEDGINGFTCRCPEGYHDPTCL

SEQ ID NO: 896 - protein, 36 aa, Homo sapiens
EVNECNSNPCVHGACRDSLNGYKCDCDPGWSGTNCD

SEQ ID NO: 897 - protein, 41 aa, Homo sapiens
DPNPCLSTPCKNAGTCHVVDRRGVADYACSCALGFSGPLCL

SEQ ID NO: 898 - protein, 37 aa, Homo sapiens
NNNECESNPCVNGGTCKDMTSGYVCTCREGFSGPNCQ

SEQ ID NO: 899 - protein, 37 aa, Homo sapiens
NINECASNPCLNQGTCIDDVAGYKCNCLLPYTGATCE

SEQ ID NO: 900 - protein, 39 aa, Homo sapiens
VLAPCAPSPCRNGGECRQSEDYESFSCVCPTGWQGQTCE

SEQ ID NO: 901 - protein, 37 aa, Homo sapiens
DINECVLSPCRHGASCQNTHGGYRCHCQAGYSGRNCE

SEQ ID NO: 902 - protein, 37 aa, Homo sapiens
DIDDCRPNPCHNGGSCTDGINTAFCDCLPGFRGTFCE

SEQ ID NO: 903 - protein, 37 aa, Homo sapiens
DINECASDPCRNGANCTDCVDSYTCTCPAGFSGIHCE

SEQ ID NO: 904 - protein, 37 aa, Homo sapiens
NTPDCTESSCFNGGTCVDGINSFTCLCPPGFTGSYCQ

SEQ ID NO: 905 - protein, 37 aa, Homo sapiens
DVNECDSQPCLHGGTCQDGCGSYRCTCPQGYTGPNCQ

SEQ ID NO: 906 - protein, 37 aa, Homo sapiens
LVHWCDSSPCKNGGKCWQTHTQYRCECPSGWTGLYCD

SEQ ID NO: 907 - protein, 47 aa, Homo sapiens
PSVSCEVAAQRQGVDVARLCQHGGLCVDAGNTHHCRCQAGYTGSYCE

SEQ ID NO: 908 - protein, 38 aa, Homo sapiens
LDNACLTNPCRNGGTCDLLTLTEYKCRCPPGWSGKSCQ

SEQ ID NO: 909 - protein, 37 aa, Homo sapiens
LVDECSPSPCQNGATCTDYLGGYSCKCVAGYHGVNCS

SEQ ID NO: 910 - protein, 37 aa, Homo sapiens
EIDECLSHPCQNGGTCLDLPNTYKCSCPRGTQGVHCE

SEQ ID NO: 911 - protein, 45 aa, Homo sapiens
NVDDCNPPVDPVSRSPKCFNNGTCVDQVGGYSCTCPPGFVGERCE

SEQ ID NO: 912 - protein, 39 aa, Homo sapiens
DVNECLSNPCDARGTQNCVQRVNDFHCECRAGHTGRRCE

SEQ ID NO: 913 - protein, 40 aa, Homo sapiens
VINGCKGKPCKNGGTCAVASNTARGFICKCPAGFEGATCE

SEQ ID NO: 914 - protein, 37 aa, Homo sapiens
DARTCGSLRCLNGGTCISGPRSPTCLCLGPFTGPECQ

SEQ ID NO: 915 - protein, 40 aa, Homo sapiens
ASSPCLGGNPCYNQGTCEPTSESPFYRCLCPAKFNGLLCH

SEQ ID NO: 916 - protein, 37 aa, Homo sapiens
QADPCASNPCANGGQCLPFEASYICHCPPSFHGPTCR

SEQ ID NO: 917 - protein, 39 aa, Homo sapiens
DVNECGQKPGLCRHGGTCHNEVGSYRCVCRATHTGPNCE

SEQ ID NO: 918 - protein, 38 aa, Homo sapiens
PYVPCSPSPCQNGGTCRPTGDVTHECACLPGFTGQNCE

SEQ ID NO: 919 - protein, 37 aa, Homo sapiens
NIDDCPGNNCKNGGACVDGVNTYNCRCPPEWTGQYCT

SEQ ID NO: 920 - protein, 39 aa, Homo sapiens
DVDECQLMPNACQNGGTCHNTHGGYNCVCVNGWTGEDCS

SEQ ID NO: 921 - protein, 37 aa, Homo sapiens
NIDDCASAACFHGATCHDRVASFYCECPHGRTGLLCH

SEQ ID NO: 922 - protein, 38 aa, Homo sapiens
LQCRDGYEPCVNEGMCVTYHNGTGYCKCPEGFLGEYCQ

SEQ ID NO: 923 - protein, 39 aa, Homo sapiens
LDDACISNPCHKGALCDTNPLNGQYICTCPQGYKGADCT

SEQ ID NO: 924 - protein, 40 aa, Homo sapiens
DVDECAMANSNPCEHAGKCVNTDGAFHCECLKGYAGPRCE

SEQ ID NO: 925 - protein, 37 aa, Homo sapiens
DINECHSDPCQNDATCLDKIGGFTCLCMPGFKGVHCE

SEQ ID NO: 926 - protein, 37 aa, Homo sapiens
EINECQSNPCVNNGQCVDKVNRFQCLCPPGFTGPVCQ

SEQ ID NO: 927 - protein, 37 aa, Homo sapiens
DIDDCSSTPCLNGAKCIDHPNGYECQCATGFTGVLCE

SEQ ID NO: 928 - protein, 36 aa, Homo sapiens
NIDNCDPDPCHHGQCQDGIDSYTCICNPGYMGAICS

SEQ ID NO: 929 - protein, 37 aa, Homo sapiens
QIDECYSSPCLNDGRCIDLVNGYQCNCQPGTSGVNCE

SEQ ID NO: 930 - protein, 36 aa, Homo sapiens
NFDDCASNPCIHGICMDGINRYSCVCSPGFTGQRCN

SEQ ID NO: 931 - protein, 37 aa, Homo sapiens
DIDECASNPCRKGATCINGVNGFRCICPEGPHHPSCY

SEQ ID NO: 932 - protein, 36 aa, Homo sapiens
QVNECLSNPCIHGNCTGGLSGYKCLCDAGWVGINCE

SEQ ID NO: 933 - protein, 39 aa, Homo sapiens
HRDPCEKNRCQNGGTCVAQAMLGKATCRCASGFTGEDCQ

SEQ ID NO: 934 - protein, 37 aa, Homo sapiens
DKNECLSNPCQNGGTCDNLVNGYRCTCKKGFKGYNCQ

SEQ ID NO: 935 - protein, 37 aa, Homo sapiens
NIDECASNPCLNQGTCFDDISGYTCHCVLPYTGKNCQ

SEQ ID NO: 936 - protein, 39 aa, Homo sapiens
VLAPCSPNPCENAAVCKESPNFESYTCLCAPGWQGQRCT

SEQ ID NO: 937 - protein, 37 aa, Homo sapiens
DIDECISKPCMNHGLCHNTQGSYMCECPPGFSGMDCE

SEQ ID NO: 938 - protein, 37 aa, Homo sapiens
DIDDCLANPCQNGGSCMDGVNTFSCLCLPGFTGDKCQ

SEQ ID NO: 939 - protein, 37 aa, Homo sapiens
DMNECLSEPCKNGGTCSDYVNSYTCKCQAGFDGVHCE

SEQ ID NO: 940 - protein, 37 aa, Homo sapiens
NINECTESSCFNGGTCVDGINSFSCLCPVGFTGSFCL

SEQ ID NO: 941 - protein, 37 aa, Homo sapiens
EINECSSHPCLNEGTCVDGLGTYRCSCPLGYTGKNCQ

SEQ ID NO: 942 - protein, 37 aa, Homo sapiens
LVNLCSRSPCKNKGTCVQKKAESQCLCPSGWAGAYCD

SEQ ID NO: 943 - protein, 47 aa, Homo sapiens
PNVSCDIAASRRGVLVEHLCQHSGVCINAGNTHYCQCPLGYTGSYCE

SEQ ID NO: 944 - protein, 39 aa, Homo sapiens
TSHPCFVSRPCLNGGTCHMLSRDTYECTCQVGFTGKECQ

SEQ ID NO: 945 - protein, 37 aa, Homo sapiens
QLDECASNPCQHGATCSDFIGGYRCECVPGYQGVNCE

SEQ ID NO: 946 - protein, 37 aa, Homo sapiens
EVDECQNQPCQNGGTCIDLVNHFKCSCPPGTRGLLCE

SEQ ID NO: 947 - protein, 38 aa, Homo sapiens
NIDDCARGPHCLNGGQCMDRIGGYSCRCLPGFAGERCE

SEQ ID NO: 948 - protein, 39 aa, Homo sapiens
DINECLSNPCSSEGSLDCIQLTNDYLCVCRSAFTGRHCE

SEQ ID NO: 949 - protein, 40 aa, Homo sapiens
FVDVCPQMPCLNGGTCAVASNMPDGFICRCPPGFSGARCQ

SEQ ID NO: 950 - protein, 39 aa, Homo sapiens
CESGCASSPCQHGGSCHPQRQPPYYSCQCAPPFSGSRCE

SEQ ID NO: 951 - protein, 37 aa, Homo sapiens
WTDACLSHPCANGSTCTTVANQFSCKCLTGFTGQKCE

SEQ ID NO: 952 - protein, 38 aa, Homo sapiens
DVNECDIPGHCQHGGTCLNLPGSYQCQCPQGFTGQYCD

SEQ ID NO: 953 - protein, 38 aa, Homo sapiens
LYVPCAPSPCVNGGTCRQTGDFTFECNCLPGFEGSTCE

SEQ ID NO: 954 - protein, 37 aa, Homo sapiens
NIDDCPNHRCQNGGVCVDGVNTYNCRCPPQWTGQFCT

SEQ ID NO: 955 - protein, 39 aa, Homo sapiens
DVDECLLQPNACQNGGTCANRNGGYGCVCVNGWSGDDCS

SEQ ID NO: 956 - protein, 37 aa, Homo sapiens
NIDDCAFASCTPGSTCIDRVASFSCMCPEGKAGLLCH

SEQ ID NO: 957 - protein, 38 aa, Homo sapiens
APPCLDGSPCANGGRCTQLPSREAACLCPPGWVGERCQ

SEQ ID NO: 958 - protein, 39 aa, Homo sapiens
DVDECSIGANPCEHLGRCVNTQGSFLCQCGRGYTGPRCE

SEQ ID NO: 959 - protein, 37 aa, Homo sapiens
DVNECLSGPCRNQATCLDRIGQFTCICMAGFTGTYCE

SEQ ID NO: 960 - protein, 37 aa, Homo sapiens
DIDECQSSPCVNGGVCKDRVNGFSCTCPSGFSGSTCQ

SEQ ID NO: 961 - protein, 37 aa, Homo sapiens
DVDECASTPCRNGAKCVDQPDGYECRCAEGFEGTLCD

SEQ ID NO: 962 - protein, 36 aa, Homo sapiens
NVDDCSPDPCHHGRCVDGIASFSCACAPGYTGTRCE

SEQ ID NO: 963 - protein, 37 aa, Homo sapiens
QVDECRSQPCRHGGKCLDLVDKYLCRCPSGTTGVNCE

SEQ ID NO: 964 - protein, 36 aa, Homo sapiens
NIDDCASNPCTFGVCRDGINRYDCVCQPGFTGPLCN

SEQ ID NO: 965 - protein, 37 aa, Homo sapiens
EINECASSPCGEGGSCVDGENGFRCLCPPGSLPPLCL

SEQ ID NO: 966 - protein, 36 aa, Homo sapiens
PSHPCAHEPCSHGICYDAPGGFRCVCEPGWSGPRCS

SEQ ID NO: 967 - protein, 37 aa, Homo sapiens
ARDACESQPCRAGGTCSSDGMGFHCTCPPGVQGRQCE

SEQ ID NO: 968 - protein, 41 aa, Homo sapiens
LEDPCHSGPCAGRGVCQSSVVAGTARFSCRCPRGFRGPDCS

SEQ ID NO: 969 - protein, 38 aa, Homo sapiens
LLSPCTPNPCEHGGRCESAPGQLPVCSCPQGWQGPRCQ

SEQ ID NO: 970 - protein, 38 aa, Homo sapiens
DVDECAGPAPCGPHGICTNLAGSFSCTCHGGYTGPSCD

SEQ ID NO: 971 - protein, 37 aa, Homo sapiens
DINDCDPNPCLNGGSCQDGVGSFSCSCLPGFAGPRCA

SEQ ID NO: 972 - protein, 36 aa, Homo sapiens
DVDECLSNPCGPGTCTDHVASFTCTCPPGYGGFHCE

SEQ ID NO: 973 - protein, 37 aa, Homo sapiens
DLPDCSPSSCFNGGTCVDGVNSFSCLCRPGYTGAHCQ

SEQ ID NO: 974 - protein, 37 aa, Homo sapiens
EADPCLSRPCLHGGVCSAAHPGFRCTCLESFTGPQCQ

SEQ ID NO: 975 - protein, 35 aa, Homo sapiens
LVDWCSRQPCQNGGRCVQTGAYCLCPPGWSGRLCD

SEQ ID NO: 976 - protein, 36 aa, Homo sapiens
IGVRLEQLCQAGGQCVDEDSSHYCVCPEGRTGSHCE

SEQ ID NO: 977 - protein, 37 aa, Homo sapiens
EVDPCLAQPCQHGGTCRGYMGGYMCECLPGYNGDNCE

SEQ ID NO: 978 - protein, 37 aa, Homo sapiens
DVDECASQPCQHGGSCIDLVARYLCSCPPGTLGVLCE

SEQ ID NO: 979 - protein, 38 aa, Homo sapiens
LPDPCLSSPCAHGARCSVGPDGRFLCSCPPGYQGRSCR

SEQ ID NO: 980 - protein, 44 aa, Homo sapiens
NEDDCGPGPPLDSGPRCLHNGTCVDLVGGFRCTCPPGYTGLRCE

SEQ ID NO: 981 - protein, 40 aa, Homo sapiens
DINECRSGACHAAHTRDCLQDPGGGFRCLCHAGFSGPRCQ

SEQ ID NO: 982 - protein, 42 aa, Homo sapiens
VLSPCESQPCQHGGQCRPSPGPGGGLTFTCHCAQPFWGPRCE

SEQ ID NO: 983 - protein, 37 aa, Homo sapiens
VARSCRELQCPVGVPCQQTPRGPRCACPPGLSGPSCR

SEQ ID NO: 984 - protein, 39 aa, Homo sapiens
SNASCAAAPCLHGGSCRPAPLAPFFRCACAQGWTGPRCE

SEQ ID NO: 985 - protein, 38 aa, Homo sapiens
DVDECRVGEPCRHGGTCLNTPGSFRCQCPAGYTGPLCE

SEQ ID NO: 986 - protein, 38 aa, Homo sapiens
PAVPCAPSPCRNGGTCRQSGDLTYDCACLPGFEGQNCE

SEQ ID NO: 987 - protein, 37 aa, Homo sapiens
NVDDCPGHRCLNGGTCVDGVNTYNCQCPPEWTGQFCT

SEQ ID NO: 988 - protein, 39 aa, Homo sapiens
DVDECQLQPNACHNGGTCFNTLGGHSCVCVNGWTGESCS

SEQ ID NO: 989 - protein, 37 aa, Homo sapiens
NIDDCATAVCFHGATCHDRVASFYCACPMGKTGLLCH

SEQ ID NO: 990 - protein, 39 aa, Homo sapiens
LDDACVSNPCHEDAICDTNPVNGRAICTCPPGFTGGACD

SEQ ID NO: 991 - protein, 40 aa, Homo sapiens
RGLLCGSFPEPCANGGTCLSLSLGQGTCQCAPGFLGETCQ

SEQ ID NO: 992 - protein, 39 aa, Homo sapiens
LEDMCLSQPCHGDAQCSTNPLTGSTLCLCQPGYSGPTCH

SEQ ID NO: 993 - protein, 42 aa, Homo sapiens
DLDECLMAQQGPSPCEHGGSCLNTPGSFNCLCPPGYTGSRCE

SEQ ID NO: 994 - protein, 37 aa, Homo sapiens
DHNECLSQPCHPGSTCLDLLATFHCLCPPGLEGQLCE

SEQ ID NO: 995 - protein, 37 aa, Homo sapiens
ETNECASAPCLNHADCHDLLNGFQCICLPGFSGTRCE

SEQ ID NO: 996 - protein, 37 aa, Homo sapiens
DIDECRSSPCANGGQCQDQPGAFHCKCLPGFEGPRCQ

SEQ ID NO: 997 - protein, 37 aa, Homo sapiens
EVDECLSDPCPVGASCLDLPGAFFCLCPSGFTGQLCE

SEQ ID NO: 998 - protein, 34 aa, Homo sapiens
VPLCAPNLCQPKQICKDQKDKANCLCPDGSPGCA

SEQ ID NO: 999 - protein, 29 aa, Homo sapiens
PEDNCTCHHGHCQRSSCVCDVGWTGPECE

SEQ ID NO: 1000 - protein, 37 aa, Homo sapiens
ELGGCISAPCAHGGTCYPQPSGYNCTCPTGYTGPTCS

SEQ ID NO: 1001 - protein, 37 aa, Homo sapiens
EMTACHSGPCLNGGSCNPSPGGYYCTCPPSHTGPQCQ

SEQ ID NO: 1002 - protein, 52 aa, Homo sapiens
FPDPCQNAQLCQNGGSCQALLPAPLGLPSSPSPLTPSFLCTCLPGFTGERCQ

SEQ ID NO: 1003 - protein, 37 aa, Homo sapiens
STDYCVSAPCFNGGTCVNRPGTFSCLCAMGFQGPRCE

SEQ ID NO: 1004 - protein, 37 aa, Homo sapiens
LRPSCADSPCRNRATCQDSPQGPRCLCPTGYTGGSCQ

SEQ ID NO: 1005 - protein, 37 aa, Homo sapiens
LMDLCAQKPCPRNSHCLQTGPSFHCLCLQGWTGPLCN

SEQ ID NO: 1006 - protein, 47 aa, Homo sapiens
PLSSCQKAALSQGIDVSSLCHNGGLCVDSGPSYFCHCPPGFQGSLCQ

SEQ ID NO: 1007 - protein, 37 aa, Homo sapiens
HVNPCESRPCQNGATCMAQPSGYLCQCAPGYDGQNCS

SEQ ID NO: 1008 - protein, 37 aa, Homo sapiens
ELDACQSQPCHNHGTCTPKPGGFHCACPPGFVGLRCE

SEQ ID NO: 1009 - protein, 39 aa, Homo sapiens
DVDECLDQPCHPTGTAACHSLANAFYCQCLPGHTGQWCE

SEQ ID NO: 1010 - protein, 40 aa, Homo sapiens
EIDPCHSQPCFHGGTCEATAGSPLGFICHCPKGFEGPTCS

SEQ ID NO: 1011 - protein, 40 aa, Homo sapiens
RAPSCGFHHCHHGGLCLPSPKPGFPPRCACLSGYGGPDCL

SEQ ID NO: 1012 - protein, 42 aa, Homo sapiens
APKGCGPPSPCLYNGSCSETTGLGGPGFRCSCPHSSPGPRCQ

SEQ ID NO: 1013 - protein, 38 aa, Homo sapiens
LEDPCPPSFCSKRGRCHIQASGRPQCSCMPGWTGEQCQ

SEQ ID NO: 1014 - protein, 37 aa, Homo sapiens
LRDFCSANPCVNGGVCLATYPQIQCHCPPGFEGHACE

SEQ ID NO: 1015 - protein, 39 aa, Homo sapiens
DVNECFQDPGPCPKGTSCHNTLGSFQCLCPVGQEGPRCE

SEQ ID NO: 1016 - protein, 41 aa, Homo sapiens
RAGPCPPRGCSNGGTCQLMPEKDSTFHLCLCPPGFIGPDCE

SEQ ID NO: 1017 - protein, 37 aa, Homo sapiens
NPDNCVSHQCQNGGTCQDGLDTYTCLCPETWTGWDCS

SEQ ID NO: 1018 - protein, 40 aa, Homo sapiens
DVDECETQGPPHCRNGGTCQNSAGSFHCVCVSGWGGTSCE

SEQ ID NO: 1019 - protein, 37 aa, Homo sapiens
NLDDCIAATCAPGSTCIDRVGSFSCLCPPGRTGLLCH

SEQ ID NO: 1020 - protein, 41 aa, Homo sapiens
SRQTCANNRHQCSVHAECRDYATGFCCSCVAGYTGNGRQCV

SEQ ID NO: 1021 - protein, 42 aa, Homo sapiens
LQNPCYIGTHGCDTNAACRPGPRTQFTCECSIGFRGDGRTCY

SEQ ID NO: 1022 - protein, 42 aa, Homo sapiens
DIDECSEQPSVCGSHTICNNHPGTFRCECVEGYQFSDEGTCV

SEQ ID NO: 1023 - protein, 44 aa, Homo sapiens
PINYCETGLHNCDIPQRAQCIYTGGSSYTCSCLPGFSGDGQACQ

SEQ ID NO: 1024 - protein, 39 aa, Homo sapiens
DVDECQPSRCHPDAFCYNTPGSFTCQCKPGYQGDGFRCV

SEQ ID NO: 1025 - protein, 37 aa, Homo sapiens
GHNYCSVNNGGCTHLCLATPGSRTCRCPDNTLGVDCI

SEQ ID NO: 1026 - protein, 41 aa, Homo sapiens
NKETCEHNHRQCSRHAFCTDYATGFCCHCQSKFYGNGKHCL

SEQ ID NO: 1027 - protein, 42 aa, Homo sapiens
PGNPCYDGSHMCDTTARCHPGTGVDYTCECASGYQGDGRNCV

SEQ ID NO: 1028 - protein, 43 aa, Homo sapiens
DENECATGFHRCGPNSVCINLPGSYRCECRSGYEFADDRHTCI

SEQ ID NO: 1029 - protein, 44 aa, Homo sapiens
PANPCEDGSHTCAPAGQARCVHHGGSTFSCACLPGYAGDGHQCT

SEQ ID NO: 1030 - protein, 39 aa, Homo sapiens
DVDECSENRCHPAATCYNTPGSFSCRCQPGYYGDGFQCI

SEQ ID NO: 1031 - protein, 24 aa, Homo sapiens
MCVTYHNGTGYCKCPEGFLGEYCQ

SEQ ID NO: 1032 - protein, 38 aa, Homo sapiens
DVNECDIPGHCQHGGTCLNLPGSYQCQCLQGFTGQYCD

SEQ ID NO: 1033 - protein, 38 aa, Homo sapiens
LYVPCAPSPCVNGGTCRQTGDFTFECNCLPETVRRGTE

SEQ ID NO: 1034 - protein, 41 aa, Homo sapiens
DENECEQNNGGCSEICVNLKNSYRCECGVGRVLRSDGKTCE

SEQ ID NO: 1035 - protein, 38 aa, Homo sapiens
HRAKCAPSYLFSCFNGGECVHPAFCDCRRFNATGPRCQ

SEQ ID NO: 1036 - protein, 45 aa, Homo sapiens
VEDKCEKACRPEEECLALNSTWGCFCRQDLNSSDVHSLQPQLDCG

SEQ ID NO: 1037 - protein, 33 aa, Homo sapiens
DCSRPCPPGRQKSPRDPCQCVCHGSAVTTQDCC

SEQ ID NO: 1038 - protein, 39 aa, Homo sapiens
FDMPCDETLCSADSFCVNDYTWGGSRCQCTLGKGGESCS

SEQ ID NO: 1039 - protein, 38 aa, Homo sapiens
SSGICDEASCIHGGTCTAIKADSYICLCPLGFKGRHCE

SEQ ID NO: 1040 - protein, 37 aa, Homo sapiens
AAHPCVRAPCAHGGSCRPRKEGYDCDCPLGFEGLHCQ

SEQ ID NO: 1041 - protein, 31 aa, Homo sapiens
VPLCAQECVHGRCVAPNQCQCVPGWRGDDCS

SEQ ID NO: 1042 - protein, 36 aa, Homo sapiens
SGFFCPSTHSCQNGGVFQTPQGSCSCPPGWMGTICS

SEQ ID NO: 1043 - protein, 36 aa, Homo sapiens
HGPNCSQECRCHNGGLCDRFTGQCRCAPGYTGDRCR

SEQ ID NO: 1044 - protein, 36 aa, Homo sapiens
FGQDCAETCDCAPDARCFPANGACLCEHGFTGDRCT

SEQ ID NO: 1045 - protein, 36 aa, Homo sapiens
HGPGCQEHCLCLHGGVCQATSGLCQCAPGYTGPHCA

SEQ ID NO: 1046 - protein, 36 aa, Homo sapiens
WGFSCNASCQCAHEAVCSPQTGACTCTPGWHGAHCQ

SEQ ID NO: 1047 - protein, 31 aa, Homo sapiens
SNTCTCKNGGTCLPENGNCVCAPGFRGPSCQ

SEQ ID NO: 1048 - protein, 35 aa, Homo sapiens
YGKRCVPCKCANHSFCHPSNGTCYCLAGWTGPDCS

SEQ ID NO: 1049 - protein, 36 aa, Homo sapiens
WGENCAQTCQCHHGGTCHPQDGSCICPLGWTGHHCL

SEQ ID NO: 1050 - protein, 41 aa, Homo sapiens
HFSRCPKQYKHYCIKGRCRFVVAEQTPSCVCDEGYIGARCE

SEQ ID NO: 1051 - protein, 42 aa, Homo sapiens
EQKLCKLRKGNCSSTVCGQDLQSHLCMCAEGYALSRDRKYCE

SEQ ID NO: 1052 - protein, 41 aa, Homo sapiens
DVNECAFWNHGCTLGCKNTPGSYYCTCPVGFVLLPDGKRCH

SEQ ID NO: 1053 - protein, 41 aa, Homo sapiens
QLVSCPRNVSECSHDCVLTSEGPLCFCPEGSVLERDGKTCS

SEQ ID NO: 1054 - protein, 43 aa, Homo sapiens
TCSGCSSPDNGGCSQLCVPLSPVSWECDCFPGYDLQLDEKSCA

SEQ ID NO: 1055 - protein, 41 aa, Homo sapiens
GADPCLYQNGGCEHICKKRLGTAWCSCREGFMKASDGKTCL

SEQ ID NO: 1056 - protein, 39 aa, Homo sapiens
DQDDCAPVGCSMYARCISEGEDATCQCLKGFAGDGKLCS

SEQ ID NO: 1057 - protein, 42 aa, Homo sapiens
DIDECEMGVPVCPPASSKCINTEGGYVCRCSEGYQGDGIHCL

SEQ ID NO: 1058 - protein, 41 aa, Homo sapiens
DIDECQLGEHSCGENASCTNTEGGYTCMCAGRLSEPGLICP

SEQ ID NO: 1059 - protein, 42 aa, Homo sapiens
SDSECPLSHDGYCLHDGVCMYIEALDKYACNCVVGYIGERCQ

SEQ ID NO: 1060 - protein, 41 aa, Homo sapiens
SITKCSSDMNGYCLHGQCIYLVDMSQNYCRCEVGYTGVRCE

SEQ ID NO: 1061 - protein, 41 aa, Homo sapiens
KRDPCLRKYKDFCIHGECKYVKELRAPSCICHPGYHGERCH

SEQ ID NO: 1062 - protein, 39 aa, Homo sapiens
LQGNCSRLGCQHHCVPTLDGPTCYCNSSFQLQADGKTCK

SEQ ID NO: 1063 - protein, 41 aa, Homo sapiens
ELSPCRINNGGCQDLCLLTHQGHVNCSCRGGRILQDDLTCR

SEQ ID NO: 1064 - protein, 41 aa, Homo sapiens
INECLSRKLSGCSQDCEDLKIGFKCRCRPGFRLKDDGRTCA

SEQ ID NO: 1065 - protein, 41 aa, Homo sapiens
DVDECSTTFPCSQRCINTHGSYKCLCVEGYAPRGGDPHSCK

SEQ ID NO: 1066 - protein, 42 aa, Homo sapiens
PNHPCKVNNGGCSNLCLLSPGGGHKCACPTNFYLGSDGRTCV

SEQ ID NO: 1067 - protein, 43 aa, Homo sapiens
KLTSCATNASICGDEARCVRTEKAAYCACRSGFHTVPGQPGCQ

SEQ ID NO: 1068 - protein, 38 aa, Homo sapiens
DINECLRFGTCSQLCNNTKGGHLCSCARNFMKTHNTCK

SEQ ID NO: 1069 - protein, 37 aa, Homo sapiens
VTNPCDRKKCEWLCLLSPSGPVCTCPNGKRLDNGTCV

SEQ ID NO: 1070 - protein, 37 aa, Homo sapiens
RPGTCNLQCFNGGSCFLNARRQPKCRCQPRYTGDKCE

SEQ ID NO: 1071 - protein, 37 aa, Homo sapiens
ELDQCWEHCRNGGTCAASPSGMPTCRCPTGFTGPKCT

SEQ ID NO: 1072 - protein, 37 aa, Homo sapiens
TQQVCAGYCANNSTCTVNQGNQPQCRCLPGFLGDRCQ

SEQ ID NO: 1073 - protein, 40 aa, Homo sapiens
DFDECSVYGTCSQLCTNTDGSFICGCVEGYLLQPDNRSCK

SEQ ID NO: 1074 - protein, 37 aa, Homo sapiens
QYRQCSGYCENFGTCQMAADGSRQCRCTAYFEGSRCE

SEQ ID NO: 1075 - protein, 36 aa, Homo sapiens
EVNKCSRCLEGACVVNKQSGDVTCNCTDGRVAPSCL

SEQ ID NO: 1076 - protein, 37 aa, Homo sapiens
SCLTCVGHCSNGGSCTMNSKMMPECQCPPHMTGPRCE

SEQ ID NO: 1077 - protein, 47 aa, Homo sapiens
RSHACENDQYGKPGGCSDICLLANSHKARTCRCRSGFSLGSDGKSCK

SEQ ID NO: 1078 - protein, 41 aa, Homo sapiens
GTNKCRVNNGGCSSLCLATPGSRQCACAEDQVLDADGVTCL

SEQ ID NO: 1079 - protein, 40 aa, Homo sapiens
DQCSLNNGGCSHNCSVAPGEGIVCSCPLGMELGPDNHTCQ

SEQ ID NO: 1080 - protein, 40 aa, Homo sapiens
IQSYCAKHLKCSQKCDQNKFSVKCSCYEGWVLEPDGESCR

SEQ ID NO: 1081 - protein, 44 aa, Homo sapiens
APNPCEANGGQGPCSHLCLINYNRTVSCACPHLMKLHKDNTTCY

SEQ ID NO: 1082 - protein, 42 aa, Homo sapiens
GTNPCSVNNGDCSQLCLPTSETTRSCMCTAGYSLRSGQQACE

SEQ ID NO: 1083 - protein, 41 aa, Homo sapiens
GTNVCAVANGGCQQLCLYRGRGQRACACAHGMLAEDGASCR

SEQ ID NO: 1084 - protein, 45 aa, Homo sapiens
HLVKCAEKEKTFCVNGGECFMVKDLSNPSRYLCKCQPGFTGARCT

SEQ ID NO: 1085 - protein, 42 aa, Homo sapiens
HARKCNETAKSYCVNGGVCYYIEGINQLSCKCPNGFFGQRCL

SEQ ID NO: 1086 - protein, 44 aa, Homo sapiens
HFKPCRDKDLAYCLNDGECFVIETLTGSHKHCRCKEGYQGVRCD

SEQ ID NO: 1087 - protein, 42 aa, Homo sapiens
HEEPCGPSHKSFCLNGGLCYVIPTIPSPFCRCVENYTGARCE

SEQ ID NO: 1088 - protein, 39 aa, Homo sapiens
PVNPCCYYPCQHQGICVRFGLDRYQCDCTRTGYSGPNCT

SEQ ID NO: 1089 - protein, 38 aa, Homo sapiens
ANPCCSHPCQNRGVCMSVGFDQYKCDCTRTGFYGENCS

SEQ ID NO: 1090 - protein, 39 aa, Homo sapiens
NNTRCLSNSCQNNSTCKDFSKDNDCSCSDTANNLDKDCD

SEQ ID NO: 1091 - protein, 43 aa, Homo sapiens
DVNECSSNPCQNGGTCENLPGNYTCHCPFDNLSRTFYGGRDCS

SEQ ID NO: 1092 - protein, 41 aa, Homo sapiens
ILLGCTHQQCLNNGTCIPHFQDGQHGFSCLCPSGYTGSLCE

SEQ ID NO: 1093 - protein, 37 aa, Homo sapiens
RKDWCESQPCQSRGRCINLWLSYQCDCHRPYEGPNCL

SEQ ID NO: 1094 - protein, 37 aa, Homo sapiens
GDNSCKSNPCHNGGVCHSRWDDFSCSCPALTSGKACE

SEQ ID NO: 1095 - protein, 37 aa, Homo sapiens
EVQWCGFSPCPHGAQCQPVLQGFECIANAVFNGQSGQ

SEQ ID NO: 1096 - protein, 37 aa, Homo sapiens
QLNVCNSNPCLHGGNCEDIYSSYHCSCPLGWSGKHCE

SEQ ID NO: 1097 - protein, 36 aa, Homo sapiens
NIDECFSNPCIHGNCSDRVAAYHCTCEPGYTGVNCE

SEQ ID NO: 1098 - protein, 37 aa, Homo sapiens
DIDNCQSHQCANGATCISHTNGYSCLCFGNFTGKFCR

SEQ ID NO: 1099 - protein, 41 aa, Homo sapiens
PSTVCGNEKTNLTCYNGGNCTEFQTELKCMCRPGFTGEWCE

SEQ ID NO: 1100 - protein, 37 aa, Homo sapiens
DIDECASDPCVNGGLCQDLLNKFQCLCDVAFAGERCE

SEQ ID NO: 1101 - protein, 39 aa, Homo sapiens
MKDPCFSNPCQGSATCVNTPGERSFLCKCPPGYSGTICE

SEQ ID NO: 1102 - protein, 37 aa, Homo sapiens
TIGSCGKNSCQHGGICHQDPIYPVCICPAGYAGRFCE

SEQ ID NO: 1103 - protein, 37 aa, Homo sapiens
DHDECASSPCQNGAVCQDGIDGYSCFCVPGYQGRHCD

SEQ ID NO: 1104 - protein, 37 aa, Homo sapiens
EVDECASDPCKNEATCLNEIGRYTCICPHNYSGVNCE

SEQ ID NO: 1105 - protein, 37 aa, Homo sapiens
EIDECWSQPCLNGATCQDALGAYFCDCAPGFLGDHCE

SEQ ID NO: 1106 - protein, 38 aa, Homo sapiens
NTDECASQPCLHGGLCVDGENRYSCNCTGSGFTGTHCE

SEQ ID NO: 1107 - protein, 37 aa, Homo sapiens
LMPLCWSKPCHNNATCEDSVDNYTCHCWPGYTGAQCE

SEQ ID NO: 1108 - protein, 57 aa, Homo sapiens
DLNECNSNPCQSNGECVELSSEKQYGRITGLPSSFSYHEASGYVCICQPGFTGIHCE

SEQ ID NO: 1109 - protein, 40 aa, Homo sapiens
EPRGCATQPCHHGALCVPQGPDPTGFRCYCVPGFQGPRCE

SEQ ID NO: 1110 - protein, 37 aa, Homo sapiens
RREQCRPLPCVHGGSCVDLWTHFRCDCARPHRGPTCA

SEQ ID NO: 1111 - protein, 37 aa, Homo sapiens
SEDMCSPDPCFNGGTCLVTWNDFHCTCPANFTGPTCA

SEQ ID NO: 1112 - protein, 37 aa, Homo sapiens
GAPVCAPSPCLHDGACRDLFDAFACACGPGWEGPRCE

SEQ ID NO: 1113 - protein, 37 aa, Homo sapiens
HVDPCHSAPCARGRCHTHPDGRFECRCPPGFGGPRCR

SEQ ID NO: 1114 - protein, 38 aa, Homo sapiens
PSKECSLNVTCLDGSPCEGGSPAANCSCLEGLAGQRCQ

SEQ ID NO: 1115 - protein, 37 aa, Homo sapiens
PTLPCEANPCLNGGTCRAAGGVSECICNARFSGQFCE

SEQ ID NO: 1116 - protein, 37 aa, Homo sapiens
DIDECASRPCHHGATCRNLADRYECHCPLGYAGVTCE

SEQ ID NO: 1117 - protein, 37 aa, Homo sapiens
EVDECASAPCLHGGSCLDGVGSFRCVCAPGYGGTRCQ

SEQ ID NO: 1118 - protein, 38 aa, Homo sapiens
DLDECQSQPCAHGGTCHDLVNGFRCDCAGTGYEGTHCE

SEQ ID NO: 1119 - protein, 37 aa, Homo sapiens
EVLECASAPCEHNASCLEGLGSFRCLCWPGYSGELCE

SEQ ID NO: 1120 - protein, 58 aa, Homo sapiens
DEDECASSPCQHGGRCLQRSDPALYGGVQAAFPGAFSFRHAAGFLCHCPPGFEGADCG

SEQ ID NO: 1121 - protein, 37 aa, Homo sapiens
EVDECASRPCLNGGHCQDLPNGFQCHCPDGYAGPTCE

SEQ ID NO: 1122 - protein, 37 aa, Homo sapiens
DVDECLSDPCLHGGTCSDTVAGYICRCPETWGGRDCS

SEQ ID NO: 1123 - protein, 41 aa, Homo sapiens
QLTGCQGHTCPLAATCIPIFESGVHSYVCHCPPGTHGPFCG

SEQ ID NO: 1124 - protein, 32 aa, Homo sapiens
AECFPACNPQNGFCEDDNVCRCQPGWQGPLCD

SEQ ID NO: 1125 - protein, 34 aa, Homo sapiens
LCDQCVTSPGCLHGLCGEPGQCICTDGWDGELCD

SEQ ID NO: 1126 - protein, 38 aa, Homo sapiens
DVRACSSAPCANNRTCVSLDDGLYECSCAPGYSGKDCQ

SEQ ID NO: 1127 - protein, 42 aa, Homo sapiens
KDGPCVINGSPCQHGGTCVDDEGRASHASCLCPPGFSGNFCE

SEQ ID NO: 1128 - protein, 37 aa, Homo sapiens
VANSCTPNPCENDGVCTDIGGDFRCRCPAGFIDKTCS

SEQ ID NO: 1129 - protein, 38 aa, Homo sapiens
PVTNCASSPCQNGGTCLQHTQVSYECLCKPEFTGLTCV

SEQ ID NO: 1130 - protein, 32 aa, Homo sapiens
DDCSSHCDLAHGCCAPDGSCRCDPGWEGLHCE

SEQ ID NO: 1131 - protein, 28 aa, Homo sapiens
RMPGCQHGTCHQPWQCICHSGWAGKFCD

SEQ ID NO: 1132 - protein, 39 aa, Homo sapiens
DEHICTTQSPCQNGGQCMYDGGGEYHCVCLPGFHGRDCE

SEQ ID NO: 1133 - protein, 42 aa, Homo sapiens
KAGPCEQAGSPCRNGGQCQDDQGFALNFTCRCLVGFVGARCE

SEQ ID NO: 1134 - protein, 37 aa, Homo sapiens
NVDDCLMRPCANGATCLDGINRFSCLCPEGFAGRFCT

SEQ ID NO: 1135 - protein, 37 aa, Homo sapiens
NLDDCASRPCQRGARCRDRVHDFDCLCPSGYGGKTCE

SEQ ID NO: 1136 - protein, 43 aa, Homo sapiens
KQQFCQESLSSEFCSGHGKCLSEAWSKTYSCHCQPPFSGKYCQ

SEQ ID NO: 1137 - protein, 37 aa, Homo sapiens
ESNECKMNPCKNNSTCTDLYKSYRCECTSGWTGQNCS

SEQ ID NO: 1138 - protein, 39 aa, Homo sapiens
EINECDSDPCMNGGLCHESTIPGQFVCLCPPLYTGQFCH

SEQ ID NO: 1139 - protein, 40 aa, Homo sapiens
RYNLCDLLHNPCRNNSTCLALVDANQHCICREEFEGKNCE

SEQ ID NO: 1140 - protein, 37 aa, Homo sapiens
DVKDCLFLSCQDYGDCEDMVNNFRCICRPGFSGSLCE

SEQ ID NO: 1141 - protein, 37 aa, Homo sapiens
EINECSSEPCKNNGTCVDLTNRFFCNCEPEYHGPFCE

SEQ ID NO: 1142 - protein, 37 aa, Homo sapiens
DVNKCKISPCLDEENCVYRTDGYNCLCAPGYTGINCE

SEQ ID NO: 1143 - protein, 37 aa, Homo sapiens
NLDECLSEPCLHDGVCIDGINHYTCDCKSGFFGTHCE

SEQ ID NO: 1144 - protein, 36 aa, Homo sapiens
NANDCLSNPCLHGRCTELINEYPCSCDADGTSTQCK

SEQ ID NO: 1145 - protein, 37 aa, Homo sapiens
KINDCTSIPCMNEGFCQKSAHGFTCICPRGYTGAYCE

SEQ ID NO: 1146 - protein, 43 aa, Homo sapiens
SIDNCAEPELNSVICLNGGICVDGPGHTFDCRCLPGFSGQFCE

SEQ ID NO: 1147 - protein, 42 aa, Homo sapiens
ELDACSFKPCKNNGSCINKRENWDEQAYECVCHPPFTGKNCS

SEQ ID NO: 1148 - protein, 37 aa, Homo sapiens
NINECSSSPCLHGADCEDHINGYVCKCQPGWSGHHCE

SEQ ID NO: 1149 - protein, 42 aa, Homo sapiens
APSVCQQDVCHNGGTCHAIFLSSGIVSFQCDCPLHFTGRFCE

SEQ ID NO: 1150 - protein, 34 aa, Homo sapiens
HVPWCAHHLCRNNGTCISDNENLFCECPRLYSGK

SEQ ID NO: 1151 - protein, 38 aa, Homo sapiens
QFASCENNPCGNGATCVPKSGTDIVCLCPYGRSGPLCT

SEQ ID NO: 1152 - protein, 37 aa, Homo sapiens
HASPCSLMKCGNGGTCIESGTSVYCNCTTGWKGSFCT

SEQ ID NO: 1153 - protein, 42 aa, Homo sapiens
TVSTCDPEHDPPHHCSRGATCISLPHGYTCFCPLGTTGIYCE

SEQ ID NO: 1154 - protein, 37 aa, Homo sapiens
DGTACGYNTCRNGGECTVNGTTFSCRCLPDWAGNTCN

SEQ ID NO: 1155 - protein, 38 aa, Homo sapiens
QSVSCLNNLCLHQSLCIPDQSFSYSCLCTLGWVGRYCE

SEQ ID NO: 1156 - protein, 37 aa, Homo sapiens
IIGQCQPHVCFHGNCSNITSNSFICECDEQFSGPFCE

SEQ ID NO: 1157 - protein, 37 aa, Homo sapiens
DVSEFSLVPCQNGTDCIKISNDVMCICSPIFTDLLCK

SEQ ID NO: 1158 - protein, 37 aa, Homo sapiens
IQTSCESFPLRNNATCKKCEKDYPCSCISGFTEKNCE

SEQ ID NO: 1159 - protein, 36 aa, Homo sapiens
TTDDQENECQHEAVCKDEINRPRCSCSLSYIGRLCV

SEQ ID NO: 1160 - protein, 37 aa, Homo sapiens
DTEDCKSASCKNGTTSTHLRGYFFRKCVPGFKGTQCE

SEQ ID NO: 1161 - protein, 40 aa, Homo sapiens
DIDECASHPCKNGATCIDQPGNYFCQCVPPFKVVDGFSCL

SEQ ID NO: 1162 - protein, 37 aa, Homo sapiens
DIDDCILNACEHNSTCKDLHLSYQCVCLSDWEGNFCE

SEQ ID NO: 1163 - protein, 39 aa, Homo sapiens
SVNSCAVNPCLHNGECVADNTSRGYHCRCPPSWQGDDCS

SEQ ID NO: 1164 - protein, 39 aa, Homo sapiens
DVNECLSNPCPSTAMCNNTQGSFICKCPVGYQLEKGICN

SEQ ID NO: 1165 - protein, 34 aa, Homo sapiens
NRAICRQGCSPKHGSCKLPGDCRCQYGWQGLYCD

SEQ ID NO: 1166 - protein, 42 aa, Homo sapiens
DTPEGVRYISSNVCGPHGKCKSQSGGKFTCDCNKGFTGTYCH

SEQ ID NO: 1167 - protein, 37 aa, Homo sapiens
NINDCESNPCRNGGTCIDGVNSYKCICSDGWEGAYCE

SEQ ID NO: 1168 - protein, 37 aa, Homo sapiens
NINDCSQNPCHNGGTCRDLVNDFYCDCKNGWKGKTCH

SEQ ID NO: 1169 - protein, 37 aa, Homo sapiens
RDSQCDEATCNNGGTCYDEGDAFKCMCPGGWEGTTCN

SEQ ID NO: 1170 - protein, 37 aa, Homo sapiens
RNSSCLPNPCHNGGTCVVNGESFTCVCKEGWEGPICA

SEQ ID NO: 1171 - protein, 37 aa, Homo sapiens
NTNDCSPHPCYNSGTCVDGDNWYRCECAPGFAGPDCR

SEQ ID NO: 1172 - protein, 37 aa, Homo sapiens
NINECQSSPCAFGATCVDEINGYRCVCPPGHSGAKCQ

SEQ ID NO: 1173 - protein, 31 aa, Homo sapiens
KCIPHPGCVHGICNEPWQCLCETNWGGQLCD

SEQ ID NO: 1174 - protein, 39 aa, Homo sapiens
DLNYCGTHQPCLNGGTCSNTGPDKYQCSCPEGYSGPNCE

SEQ ID NO: 1175 - protein, 37 aa, Homo sapiens
AEHACLSDPCHNRGSCKETSLGFECECSPGWTGPTCS

SEQ ID NO: 1176 - protein, 37 aa, Homo sapiens
NIDDCSPNNCSHGGTCQDLVNGFKCVCPPQWTGKTCQ

SEQ ID NO: 1177 - protein, 37 aa, Homo sapiens
DANECEAKPCVNAKSCKNLIASYYCDCLPGWMGQNCD

SEQ ID NO: 1178 - protein, 36 aa, Homo sapiens
NINDCLGQCQNDASCRDLVNGYRCICPPGYAGDHCE

SEQ ID NO: 1179 - protein, 37 aa, Homo sapiens
DIDECASNPCLNGGHCQNEINRFQCLCPTGFSGNLCQ

SEQ ID NO: 1180 - protein, 37 aa, Homo sapiens
DIDYCEPNPCQNGAQCYNRASDYFCKCPEDYEGKNCS

SEQ ID NO: 1181 - protein, 34 aa, Homo sapiens
KEAVCKQGCNLLHGGCTVPGECRCSYGWQGRFCD

SEQ ID NO: 1182 - protein, 61 aa, Homo sapiens
PREPCPGGACRVIDGCGSDAGPGMPGTAASGVCGPHGRCVSQPGGNFSCICDSGFTGTYCH

SEQ ID NO: 1183 - protein, 37 aa, Homo sapiens
NIDDCLGQPCRNGGTCIDEVDAFRCFCPSGWEGELCD

SEQ ID NO: 1184 - protein, 37 aa, Homo sapiens
NPNDCLPDPCHSRGRCYDLVNDFYCACDDGWKGKTCH

SEQ ID NO: 1185 - protein, 37 aa, Homo sapiens
REFQCDAYTCSNGGTCYDSGDTFRCACPPGWKGSTCA

SEQ ID NO: 1186 - protein, 37 aa, Homo sapiens
KNSSCLPNPCVNGGTCVGSGASFSCICRDGWEGRTCT

SEQ ID NO: 1187 - protein, 37 aa, Homo sapiens
NTNDCNPLPCYNGGICVDGVNWFRCECAPGFAGPDCR

SEQ ID NO: 1188 - protein, 37 aa, Homo sapiens
NIDECQSSPCAYGATCVDEINGYRCSCPPGRAGPRCQ

SEQ ID NO: 1189 - protein, 31 aa, Homo sapiens
ECVPYPGCVHGSCVEPWQCNCETNWGGLLCD

SEQ ID NO: 1190 - protein, 39 aa, Homo sapiens
DLNYCGSHHPCTNGGTCINAEPDQYRCTCPDGYSGRNCE

SEQ ID NO: 1191 - protein, 37 aa, Homo sapiens
AEHACTSNPCANGGSCHEVPSGFECHCPSGWSGPTCA

SEQ ID NO: 1192 - protein, 37 aa, Homo sapiens
DIDECASNPCAAGGTCVDQVDGFECICPEQWVGATCQ

SEQ ID NO: 1193 - protein, 37 aa, Homo sapiens
DANECEGKPCLNAFSCKNLIGGYYCDCIPGWKGINCH

SEQ ID NO: 1194 - protein, 36 aa, Homo sapiens
NVNDCRGQCQHGGTCKDLVNGYQCVCPRGFGGRHCE

SEQ ID NO: 1195 - protein, 37 aa, Homo sapiens
ERDECASSPCHSGGLCEDLADGFHCHCPQGFSGPLCE

SEQ ID NO: 1196 - protein, 37 aa, Homo sapiens
DVDLCEPSPCRNGARCYNLEGDYYCACPDDFGGKNCS

SEQ ID NO: 1197 - protein, 42 aa, Homo sapiens
DIDECAAKMHYCHANTVCVNLPGLYRCDCVPGYIRVDDFSCT

SEQ ID NO: 1198 - protein, 41 aa, Homo sapiens
EHDECGSGQHNCDENAICTNTVQGHSCTCKPGYVGNGTICR

SEQ ID NO: 1199 - protein, 31 aa, Homo sapiens
AFCEEGCRYGGTCVAPNKCVCPSGFTGSHCE

SEQ ID NO: 1200 - protein, 39 aa, Homo sapiens
DIDECSEGIIECHNHSRCVNLPGWYHCECRSGFHDDGTY

SEQ ID NO: 1201 - protein, 36 aa, Homo sapiens
DIDECALRTHTCWNDSACINLAGGFDCLCPSGPSCS

SEQ ID NO: 1202 - protein, 43 aa, Homo sapiens
GYDFCSERHNCMENSICRNLNDRAVCSCRDGFRALREDNAYCE

SEQ ID NO: 1203 - protein, 42 aa, Homo sapiens
DIDECAEGRHYCRENTMCVNTPGSFMCICKTGYIRIDDYSCT

SEQ ID NO: 1204 - protein, 36 aa, Homo sapiens
DIDECGTGRHSCANDTICFNLDGGYDCRCPHGKNCT

SEQ ID NO: 1205 - protein, 41 aa, Homo sapiens
EHDECITNQHNCDENALCFNTVGGHNCVCKPGYTGNGTTCK

SEQ ID NO: 1206 - protein, 31 aa, Homo sapiens
AFCKDGCRNGGACIAANVCACPQGFTGPSCE

SEQ ID NO: 1207 - protein, 47 aa, Homo sapiens
DIDECSDGFVQCDSRANCINLPGWYHCECRDGYHDNGMFSPSGESCE

SEQ ID NO: 1208 - protein, 38 aa, Homo sapiens
VHHGCEDDPCPEGSECVSDPWEEKHTCVCPSGRFGQCP

SEQ ID NO: 1209 - protein, 38 aa, Homo sapiens
ATEDCASNPCQNGGVCNPSPAGGYYCKCSALYIGTHCE

SEQ ID NO: 1210 - protein, 37 aa, Homo sapiens
SVNPCSSKPCLYGGTCVVDNGGFVCQCRGLYTGQRCQ

SEQ ID NO: 1211 - protein, 37 aa, Homo sapiens
LSPYCKDEPCKNGGTCFDSLDGAVCQCDSGFRGERCQ

SEQ ID NO: 1212 - protein, 37 aa, Homo sapiens
DIDECSGNPCLHGALCENTHGSYHCNCSHEYRGRHCE

SEQ ID NO: 1213 - protein, 38 aa, Homo sapiens
HSDYCSQNTCLNGGKCSWTHGAGYVCKCPPQFSGKHCE

SEQ ID NO: 1214 - protein, 37 aa, Homo sapiens
GRENCTFAPCLEGGTCILSPKGASCNCPHPYTGDRCE

SEQ ID NO: 1215 - protein, 39 aa, Homo sapiens
SNDPCVEKPCPGDMQCVSYEASRRPFLCQCPPGKLGECS

SEQ ID NO: 1216 - protein, 38 aa, Homo sapiens
YPDACKRSPCQHGGSCTGLPSGGYQCTCLSQFTGRNCE

SEQ ID NO: 1217 - protein, 37 aa, Homo sapiens
EITACFPNPCRNGGSCDPIGNTFICNCKAGLTGVTCE

SEQ ID NO: 1218 - protein, 37 aa, Homo sapiens
DINECEREECENGGSCVNVFGSFLCNCTPGYVGQYCG

SEQ ID NO: 1219 - protein, 59 aa, Homo sapiens
DHDSCVHGPCQNGGSCLRRLAVSSVLKSRESLPVIIVANEPLQPFLCKCLPGYAGSWCE

SEQ ID NO: 1220 - protein, 37 aa, Homo sapiens
DIDECLPSPCHSGGTCHNLVGGFSCSCPDGFTGRACE

SEQ ID NO: 1221 - protein, 37 aa, Homo sapiens
DINECLQSPCKNGAICQNFPGSFNCVCKTGYTGKMCE

SEQ ID NO: 1222 - protein, 37 aa, Homo sapiens
SVNYCECNPCFNGGSCQSGVDSYYCHCPFGVFGKHCE

SEQ ID NO: 1223 - protein, 37 aa, Homo sapiens
LEGACTRSPCQHGGTCMDYWSWQQCHCKEGLTGKYCE

SEQ ID NO: 1224 - protein, 38 aa, Homo sapiens
PPGDCASHPCQNGGSCEPGLHSGFTCSCPDSHTGRTCE

SEQ ID NO: 1225 - protein, 41 aa, Homo sapiens
HFNDCPDSHTQFCFHGTCRFLVQEDKPACVCHSGYVGARCE

SEQ ID NO: 1226 - protein, 37 aa, Homo sapiens
YTASCQDMSCSKQGECLETIGNYTCSCYPGFYGPECE

SEQ ID NO: 1227 - protein, 35 aa, Homo sapiens
NLKLCDASNHCDRHGVCNNFNHCHCEKGYNPPYCQ

SEQ ID NO: 1228 - protein, 39 aa, Homo sapiens
CPPCPKYASCHNSTHCTCEDGFRARSGRTYFHDSSEKCE

SEQ ID NO: 1229 - protein, 51 aa, Homo sapiens
DINECETGLAKCKYKAYCRNKVGGYICSCLVKYTLFNFLAGIIDYDHPDCY

SEQ ID NO: 1230 - protein, 30 aa, Homo sapiens
LNRTCCLNGGTCMLESFCACPPSFYGRNCE

SEQ ID NO: 1231 - protein, 32 aa, Homo sapiens
IGPSCLKFCSGRGQCTRHGCKCDPGFSGPACE

SEQ ID NO: 1232 - protein, 32 aa, Homo sapiens
IGQQCPNMCSGHGSCDHGICRCDQGYQGTECH

SEQ ID NO: 1233 - protein, 34 aa, Homo sapiens
ISEPCPSYCSGHGDCISGVCFCDLGYTAAQGTCV

SEQ ID NO: 1234 - protein, 32 aa, Homo sapiens
LASGCPWMCSGRGICDAGRCVCDRGFGGPYCV

SEQ ID NO: 1235 - protein, 33 aa, Homo sapiens
IGPQCEEMCNGQGSCINGTKCICDPGYSGPTCK

SEQ ID NO: 1236 - protein, 32 aa, Homo sapiens
IGDGCIDMCSGHGRCIQGNCVCDEQWGGLYCD

SEQ ID NO: 1237 - protein, 32 aa, Homo sapiens
LGPGCLDNCRGHGDCLREQCICDPGYSGPNCY

SEQ ID NO: 1238 - protein, 33 aa, Homo sapiens
IGEACPKLCSGHGYCTTGAICICDESFQGDDCS

SEQ ID NO: 1239 - protein, 35 aa, Homo sapiens
TIPICEGPDACQKDEVCVKPGLCRCKPGFFGAHCS

SEQ ID NO: 1240 - protein, 36 aa, Homo sapiens
WGPDCRESCPCHPHGQCEPATGACQCQADRWGARCE

SEQ ID NO: 1241 - protein, 37 aa, Homo sapiens
WSSTCRRPCQCNTAAARCEQATGACVCKPGWWGRRCS

SEQ ID NO: 1242 - protein, 35 aa, Homo sapiens
WGPECQQQCECVRGRCSAASGECTCPPGFRGARCE

SEQ ID NO: 1243 - protein, 38 aa, Homo sapiens
FGESCEQQCPHCRHGEACEPDTGHCQRCDPGWLGPRCE

SEQ ID NO: 1244 - protein, 32 aa, Homo sapiens
CGSTCPTCVQGSCDTVTGDCVCSAGYWGPSCN

SEQ ID NO: 1245 - protein, 40 aa, Homo sapiens
QGDECGIAVCEGNSTCSENEVCVRPGECRCRHGYFGANCD

SEQ ID NO: 1246 - protein, 32 aa, Homo sapiens
CKELCSCHPHGQCEDVTGQCTCHARRWGARCE

SEQ ID NO: 1247 - protein, 35 aa, Homo sapiens
WGARCEHACQCQHGTCHPRSGACRCEPGWWGAQCA

SEQ ID NO: 1248 - protein, 30 aa, Homo sapiens
SACYCSATSRCDPQTGACLCHAGWWGRSCN

SEQ ID NO: 1249 - protein, 29 aa, Homo sapiens
NQCACNSSPCEQQSGRCQCRERTFGARCD

SEQ ID NO: 1250 - protein, 35 aa, Homo sapiens
FGARCDRYCQCFRGRCHPVDGTCACEPGYRGKYCR

SEQ ID NO: 1251 - protein, 32 aa, Homo sapiens
CAFVCADCGSGHCDFQSGRCLCSPGVHGPHCN

SEQ ID NO: 1252 - protein, 40 aa, Homo sapiens
CPLTCDDISGQVTCPPDWPCGSPGCWCPEGQVLGSEGWCV

SEQ ID NO: 1253 - protein, 38 aa, Homo sapiens
WPRQCPCLVDGARYWPGQRIKADCQLCICQDGRPRRCR

SEQ ID NO: 1254 - protein, 41 aa, Homo sapiens
DVDECSEGTDDCHIDAICQNTPKSYKCLCKPGYKGEGKQCE

SEQ ID NO: 1255 - protein, 43 aa, Homo sapiens
DIDECENDYYNGGCVHECINIPGNYRCTCFDGFMLAHDGHNCL

SEQ ID NO: 1256 - protein, 37 aa, Homo sapiens
DVDECQDNNGGCQQICVNAMGSYECQCHSGFFLSDNQ

SEQ ID NO: 1257 - protein, 37 aa, Homo sapiens
CMNKDHGCAHICRETPKGGVACDCRPGFDLAQNQKDC

SEQ ID NO: 1258 - protein, 39 aa, Homo sapiens
GRTCIETCAVNNGGCDRTCKDTATGVRCSCPVGFTLQPD

SEQ ID NO: 1259 - protein, 36 aa, Homo sapiens
CAVNNGGCDRTCKDTATGVRCSCPVGFTLQPDGKTC

SEQ ID NO: 1260 - protein, 41 aa, Homo sapiens
DINECLVNNGGCDHFCRNTVGSFECGCRKGYKLLTDERTCQ

SEQ ID NO: 1261 - protein, 39 aa, Homo sapiens
DIDECSFERTCDHICINSPGSFQCLCHRGYILYGTTHCG

SEQ ID NO: 1262 - protein, 41 aa, Homo sapiens
DVDECSMSNGSCDQGCVNTKGSYECVCPPGRRLHWNGKDCV

SEQ ID NO: 1263 - protein, 41 aa, Homo sapiens
DVDECAQGLDDCHADALCQNTPTSYKCSCKPGYQGEGRQCE

SEQ ID NO: 1264 - protein, 42 aa, Homo sapiens
DIDECGNELNGGCVHDCLNIPGNYRCTCFDGFMLAHDGHNCL

SEQ ID NO: 1265 - protein, 41 aa, Homo sapiens
DVDECLENNGGCQHTCVNVMGSYECCCKEGFFLSDNQHTCI

SEQ ID NO: 1266 - protein, 37 aa, Homo sapiens
CMNKDHGCSHICKEAPRGSVACECRPGFELAKNQRDC

SEQ ID NO: 1267 - protein, 36 aa, Homo sapiens
CNHGNGGCQHSCDDTADGPECSCHPQYKMHTDGRSC

SEQ ID NO: 1268 - protein, 36 aa, Homo sapiens
CAVNNGGCDRTCKDTSTGVHCSCPVGFTLQLDGKTC

SEQ ID NO: 1269 - protein, 41 aa, Homo sapiens
DIDECQTRNGGCDHFCKNIVGSFDCGCKKGFKLLTDEKSCQ

SEQ ID NO: 1270 - protein, 39 aa, Homo sapiens
DVDECSLDRTCDHSCINHPGTFACACNRGYTLYGFTHCG

SEQ ID NO: 1271 - protein, 41 aa, Homo sapiens
DTNECSINNGGCQQVCVNTVGSYECQCHPGYKLHWNKKDCV

SEQ ID NO: 1272 - protein, 41 aa, Homo sapiens
DVDECVEGTDNCHIDAICQNTPRSYKCICKSGYTGDGKHCK

SEQ ID NO: 1273 - protein, 42 aa, Homo sapiens
DVDECEREDNAGCVHDCVNIPGNYRCTCYDGFHLAHDGHNCL

SEQ ID NO: 1274 - protein, 37 aa, Homo sapiens
DVDECAEGNGGCQQSCVNMMGSYECHCREGFFLSDNQ

SEQ ID NO: 1275 - protein, 42 aa, Homo sapiens
EGMNCMNKNHGCAHICRETPKGGIACECRPGFELTKNQRDCK

SEQ ID NO: 1276 - protein, 39 aa, Homo sapiens
LTCNYGNGGCQHTCDDTEQGPRCGCHIKFVLHTDGKTCI

SEQ ID NO: 1277 - protein, 39 aa, Homo sapiens
ETCAVNNGGCDSKCHDAATGVHCTCPVGFMLQPDRKTCK

SEQ ID NO: 1278 - protein, 41 aa, Homo sapiens
DIDECRLNNGGCDHICRNTVGSFECSCKKGYKLLINERNCQ

SEQ ID NO: 1279 - protein, 39 aa, Homo sapiens
DIDECSFDRTCDHICVNTPGSFQCLCHRGYLLYGITHCG

SEQ ID NO: 1280 - protein, 42 aa, Homo sapiens
DVDECSINRGGCRFGCINTPGSYQCTCPAGQGRLHWNGKDCT

SEQ ID NO: 1281 - protein, 36 aa, Homo sapiens
DLCLSSPCQNQGTCHNDPLEVYRCACPSGYKGRDCE

SEQ ID NO: 1282 - protein, 40 aa, Homo sapiens
SLDSCSSGPCENGGTCHAQEGEDAPFTCSCPTGFEGPTCG

SEQ ID NO: 1283 - protein, 37 aa, Homo sapiens
NTDDCVDHACANGGVCVDGVGNYTCQCPLQYEGKACE

SEQ ID NO: 1284 - protein, 39 aa, Homo sapiens
LVDLCSPDLNPCQHEAQCVGTPDGPRCECMPGYAGDNCS

SEQ ID NO: 1285 - protein, 37 aa, Homo sapiens
NQDDCRDHRCQNGAQCMDEVNSYSCLCAEGYSGQLCE

SEQ ID NO: 1286 - protein, 37 aa, Homo sapiens
PKSPCEGTECQNGANCVDQGNRPVCQCLPGFGGPECE

SEQ ID NO: 1287 - protein, 35 aa, Homo sapiens
EPCRKLYCLHGICQPNATPGPMCHCEAGWVGLHCD

SEQ ID NO: 1288 - protein, 37 aa, Homo sapiens
ADGPCHGHKCVHGQCVPLDALSYSCQCQDGYSGALCN

SEQ ID NO: 1289 - protein, 37 aa, Homo sapiens
LAEPCRGLQCLHGHCQASGTKGAHCVCDPGFSGELCE

SEQ ID NO: 1290 - protein, 38 aa, Homo sapiens
KCNPCLSNPCKNDGTCNSDPVDFYRCTCPYGFKGQDCD

SEQ ID NO: 1291 - protein, 40 aa, Homo sapiens
PIHACISNPCKHGGTCHLKEGEEDGFWCICADGFEGENCE

SEQ ID NO: 1292 - protein, 37 aa, Homo sapiens
NVDDCEDNDCENNSTCVDGINNYTCLCPPEYTGELCE

SEQ ID NO: 1293 - protein, 39 aa, Homo sapiens
KLDFCAQDLNPCQHDSKCILTPKGFKCDCTPGYVGEHCD

SEQ ID NO: 1294 - protein, 37 aa, Homo sapiens
DFDDCQDNKCKNGAHCTDAVNGYTCICPEGYSGLFCE

SEQ ID NO: 1295 - protein, 37 aa, Homo sapiens
RTSPCDNFDCQNGAQCIVRINEPICQCLPGYQGEKCE

SEQ ID NO: 1296 - protein, 37 aa, Homo sapiens
GCEPCHKKVCAHGTCQPSSQAGFTCECQEGWMGPLCD

SEQ ID NO: 1297 - protein, 36 aa, Homo sapiens
NACLSSPCKNNGTCTQDPVELYRCACPYSYKGKDCT

SEQ ID NO: 1298 - protein, 40 aa, Homo sapiens
PINTCIQNPCQHGGTCHLSDSHKDGFSCSCPLGFEGQRCE

SEQ ID NO: 1299 - protein, 37 aa, Homo sapiens
NPDDCEDNDCENNATCVDGINNYVCICPPNYTGELCD

SEQ ID NO: 1300 - protein, 39 aa, Homo sapiens
VIDHCVPELNLCQHEAKCIPLDKGFSCECVPGYSGKLCE

SEQ ID NO: 1301 - protein, 37 aa, Homo sapiens
DNDDCVAHKCRHGAQCVDTINGYTCTCPQGFSGPFCE

SEQ ID NO: 1302 - protein, 37 aa, Homo sapiens
QTSPCDQYECQNGAQCIVVQQEPTCRCPPGFAGPRCE

SEQ ID NO: 1303 - protein, 26 aa, Homo sapiens
HGLCRSVEKDSVVCECRPGWTGPLCD

SEQ ID NO: 1304 - protein, 36 aa, Homo sapiens
ARDPCLGHRCHHGKCVATGTSYMCKCAEGYGGDLCD

SEQ ID NO: 1305 - protein, 37 aa, Homo sapiens
SANACSAFKCHHGQCHISDQGEPYCLCQPGFSGEHCQ

SEQ ID NO: 1306 - protein, 47 aa, Homo sapiens
CSLLCLPKANNSRSCRCPEDVSSSVLPSGDLMCDCPQGYQLKNNTCV

SEQ ID NO: 1307 - protein, 39 aa, Homo sapiens
HECPGGAETPCNGHGTCLDGMDRNGTCVCQENFRGSACQ

SEQ ID NO: 1308 - protein, 39 aa, Homo sapiens
TSPQCPRKCDPNANCVQDSAGASTCACAAGYSGNGIFCS

SEQ ID NO: 1309 - protein, 42 aa, Homo sapiens
EVDPCAHGHGGCSPHANCTKVAPGQRTCTCQDGYMGDGELCQ

SEQ ID NO: 1310 - protein, 43 aa, Homo sapiens
EINSCLIHHGGCHIHAECIPTGPQQVSCSCREGYSGDGIRTCE

SEQ ID NO: 1311 - protein, 43 aa, Homo sapiens
LLDPCSKNNGGCSPYATCKSTGDGQRTCTCDTAHTVGDGLTCR

SEQ ID NO: 1312 - protein, 35 aa, Homo sapiens
LQPVCTPPCAPEAVCRAGNSCECSLGYEGDGRVCT

SEQ ID NO: 1313 - protein, 41 aa, Homo sapiens
VADLCQDGHGGCSEHANCSQVGTMVTCTCLPDYEGDGWSCR

SEQ ID NO: 1314 - protein, 43 aa, Homo sapiens
ARNPCTDGHRGGCSEHANCLSTGLNTRRCECHAGYVGDGLQCL

SEQ ID NO: 1315 - protein, 38 aa, Homo sapiens
FGPDCQSVCSCVHGVCNHGPRGDGSCLCFAGYTGPHCD

SEQ ID NO: 1316 - protein, 35 aa, Homo sapiens
ELPVCQELRCPQNTQCSAEAPSCRCLPGYTQQGSE

SEQ ID NO: 1317 - protein, 40 aa, Homo sapiens
APNPCWPSPCSLLAQCSVSPKGQAQCHCPENYHGDGMVCL

SEQ ID NO: 1318 - protein, 41 aa, Homo sapiens
DCTQCPGGFSNPCYGKGNCSDGIQGNGACLCFPDYKGIACH

SEQ ID NO: 1319 - protein, 41 aa, Homo sapiens
SMGDCGPTGLAQHCHLHARCVSQEGVARCRCLDGFEGDGFS

SEQ ID NO: 1320 - protein, 43 aa, Homo sapiens
PSNPCSHPDRGGCSENAECVPGSLGTHHCTCHKGWSGDGRVCV

SEQ ID NO: 1321 - protein, 43 aa, Homo sapiens
AIDECELDMRGGCHTDALCSYVGPGQSRCTCKLGFAGDGYQCS

SEQ ID NO: 1322 - protein, 40 aa, Homo sapiens
PIDPCRAGNGGCHGLATCRAVGGGQRVCTCPPGFGGDGFS

SEQ ID NO: 1323 - protein, 41 aa, Homo sapiens
DCIECPGGAGSPCNGRGSCAEGMEGNGTCSCQEGFGGTACE

SEQ ID NO: 1324 - protein, 40 aa, Homo sapiens
PITSCLEQTGKCHPLASCQSTSSGVWSCVCQEGYEGDGFL

SEQ ID NO: 1325 - protein, 39 aa, Homo sapiens
TEDNCNGTCHTSANCLTNSDGTASCKCAAGFQGNGTICT

SEQ ID NO: 1326 - protein, 42 aa, Homo sapiens
AINACEISNGGCSAKADCKRTTPGRRVCTCKAGYTGDGIVCL

SEQ ID NO: 1327 - protein, 42 aa, Homo sapiens
EINPCLENHGGCDKNAECTQTGPNQAACNCLPAYTGDGKVCT

SEQ ID NO: 1328 - protein, 40 aa, Homo sapiens
LINVCLTKNGGCSEFAICNHTGQVERTCTCKPNYIGDGFT

SEQ ID NO: 1329 - protein, 35 aa, Homo sapiens
LPAVCTPPCSAHATCKENNTCECNLDYEGDGITCT

SEQ ID NO: 1330 - protein, 41 aa, Homo sapiens
VVDFCKQDNGGCAKVARCSQKGTKVSCSCQKGYKGDGHSCT

SEQ ID NO: 1331 - protein, 43 aa, Homo sapiens
EIDPCADGLNGGCHEHATCKMTGPGKHKCECKSHYVGDGLNCE

SEQ ID NO: 1332 - protein, 38 aa, Homo sapiens
FGPSCSSVCNCVHGVCNSGLDGDGTCECYSAYTGPKCD

SEQ ID NO: 1333 - protein, 42 aa, Homo sapiens
PIPECAALLCPENSRCSPSTEDENKLECKCLPNYRGDGKYCD

SEQ ID NO: 1334 - protein, 40 aa, Homo sapiens
PINPCLRKICHPHAHCTYLGPNRHSCTCQEGYRGDGQVCL

SEQ ID NO: 1335 - protein, 41 aa, Homo sapiens
MTDICKSDNPCHRNANCTTVAPGRTECICQKGYVGDGLTCY

SEQ ID NO: 1336 - protein, 41 aa, Homo sapiens
DCNQCPGGFSNPCSGNGQCADSLGGNGTCICEEGFQGSQCQ

SEQ ID NO: 1337 - protein, 41 aa, Homo sapiens
QTSACGPYVQFCHIHATCEYSNGTASCICKAGYEGDGTLCS

SEQ ID NO: 1338 - protein, 43 aa, Homo sapiens
EMDPCTGLTPGGCSRNAECIKTGTGTHTCVCQQGWTGNGRDCS

SEQ ID NO: 1339 - protein, 43 aa, Homo sapiens
EINNCLLPSAGGCHDNASCLYVGPGQNECECKKGFRGNGIDCE

SEQ ID NO: 1340 - protein, 38 aa, Homo sapiens
GLDVCATCHEHATCQQREGKKICICNYGFVGNGRTQCV

SEQ ID NO: 1341 - protein, 40 aa, Homo sapiens
DKNECQFGATLVCGNHTSCHNTPGGFYCICLEGYRATNNN

SEQ ID NO: 1342 - protein, 38 aa, Homo sapiens
DIDECEVSGLCRHGGRCVNTHGSFECYCMDGYLPRNGP

SEQ ID NO: 1343 - protein, 37 aa, Homo sapiens
VFHECFFNPCHNSGTCQQLGRGYVCLCPLGYTGLKCE

SEQ ID NO: 1344 - protein, 37 aa, Homo sapiens
DIDECSPLPCLNNGVCKDLVGEFICECPSGYTGQRCE

SEQ ID NO: 1345 - protein, 37 aa, Homo sapiens
NINECSSSPCLNKGICVDGVAGYRCTCVKGFVGLHCE

SEQ ID NO: 1346 - protein, 37 aa, Homo sapiens
EVNECQSNPCLNNAVCEDQVGGFLCKCPPGFLGTRCG

SEQ ID NO: 1347 - protein, 37 aa, Homo sapiens
NVDECLSQPCKNGATCKDGANSFRCLCAAGFTGSHCE

SEQ ID NO: 1348 - protein, 37 aa, Homo sapiens
NINECQSNPCRNQATCVDELNSYSCKCQPGFSGKRCE

SEQ ID NO: 1349 - protein, 40 aa, Homo sapiens
DVDECAVGSDCSEHASCLNVDGSYICSCVPPYTGDGKNCA

SEQ ID NO: 1350 - protein, 33 aa, Homo sapiens
EEPICILPCLNGGRCVAPYQCDCPPGWTGSRCH

SEQ ID NO: 1351 - protein, 32 aa, Homo sapiens
TAVCQSPCLNGGKCVRPNRCHCLSSWTGHNCS

SEQ ID NO: 1352 - protein, 32 aa, Homo sapiens
SEPECPGNCHLRGRCIDGQCICDDGFTGEDCS

SEQ ID NO: 1353 - protein, 32 aa, Homo sapiens
SDMSCPNDCHQHGRCVNGMCVCDDGYTGEDCR

SEQ ID NO: 1354 - protein, 32 aa, Homo sapiens
RDRQCPRDCSNRGLCVDGQCVCEDGFTGPDCA

SEQ ID NO: 1355 - protein, 32 aa, Homo sapiens
AELSCPNDCHGQGRCVNGQCVCHEGFMGKDCK

SEQ ID NO: 1356 - protein, 32 aa, Homo sapiens
KEQRCPSDCHGQGRCVDGQCICHEGFTGLDCG

SEQ ID NO: 1357 - protein, 32 aa, Homo sapiens
GQHSCPSDCNNLGQCVSGRCICNEGYSGEDCS

SEQ ID NO: 1358 - protein, 32 aa, Homo sapiens
SQLACPSDCNDQGKCVNGVCICFEGYAGADCS

SEQ ID NO: 1359 - protein, 33 aa, Homo sapiens
SREICPVPCSEEHGTCVDGLCVCHDGFAGDDCN

SEQ ID NO: 1360 - protein, 32 aa, Homo sapiens
NKPLCLNNCYNRGRCVENECVCDEGFTGEDCS

SEQ ID NO: 1361 - protein, 32 aa, Homo sapiens
SELICPNDCFDRGRCINGTCYCEEGFTGEDCG

SEQ ID NO: 1362 - protein, 32 aa, Homo sapiens
GKPTCPHACHTQGRCEEGQCVCDEGFAGVDCS

SEQ ID NO: 1363 - protein, 32 aa, Homo sapiens
SEKRCPADCHNRGRCVDGRCECDDGFTGADCG

SEQ ID NO: 1364 - protein, 32 aa, Homo sapiens
GELKCPNGCSGHGRCVNGQCVCDEGYTGEDCS

SEQ ID NO: 1365 - protein, 32 aa, Homo sapiens
SQLRCPNDCHSRGRCVEGKCVCEQGFKGYDCS

SEQ ID NO: 1366 - protein, 32 aa, Homo sapiens
ERLACPGACSGHGRCVDGRCLCHEPYVGADCG

SEQ ID NO: 1367 - protein, 31 aa, Homo sapiens
YPACPENCSGHGECVRGVCQCHEDFMSEDCS

SEQ ID NO: 1368 - protein, 31 aa, Homo sapiens
EKRCPGDCSGHGFCDTGECYCEEGFTGLDCA

SEQ ID NO: 1369 - protein, 31 aa, Homo sapiens
ASGSCPDDCNDQGRCVRGRCVCFPGYTGPSC

SEQ ID NO: 1370 - protein, 31 aa, Homo sapiens
GVRSCPGDCRGRGRCESGRCMCWPGYTGRDC

SEQ ID NO: 1371 - protein, 31 aa, Homo sapiens
GTRACPGDCRGRGRCVDGRCVCNPGFTGEDC

SEQ ID NO: 1372 - protein, 31 aa, Homo sapiens
GSRRCPGDCRGHGLCEDGVCVCDAGYSGEDC

SEQ ID NO: 1373 - protein, 31 aa, Homo sapiens
STRSCPGGCRGRGQCLDGRCVCEDGYSGEDC

SEQ ID NO: 1374 - protein, 31 aa, Homo sapiens
GVRQCPNDCSQHGVCQDGVCICWEGYVSEDC

SEQ ID NO: 1375 - protein, 31 aa, Homo sapiens
SIRTCPSNCHGRGRCEEGRCLCDPGYTGPTC

SEQ ID NO: 1376 - protein, 32 aa, Homo sapiens
ATRMCPADCRGRGRCVQGVCLCHVGYGGEDCG

SEQ ID NO: 1377 - protein, 31 aa, Homo sapiens
PASACPGGCGPRELCRAGQCVCVEGFRGPDC

SEQ ID NO: 1378 - protein, 32 aa, Homo sapiens
AIQTCPGDCRGRGECHDGSCVCKDGYAGEDCG

SEQ ID NO: 1379 - protein, 31 aa, Homo sapiens
GWPSCPGDCQGRGRCVQGVCVCRAGFSGPDC

SEQ ID NO: 1380 - protein, 31 aa, Homo sapiens
SQRSCPRGCSQRGRCEGGRCVCDPGYTGDDC

SEQ ID NO: 1381 - protein, 31 aa, Homo sapiens
GMRSCPRGCSQRGRCENGRCVCNPGYTGEDC

SEQ ID NO: 1382 - protein, 31 aa, Homo sapiens
GVRSCPRGCSQRGRCKDGRCVCDPGYTGEDC

SEQ ID NO: 1383 - protein, 31 aa, Homo sapiens
GTRSCPWDCGEGGRCVDGRCVCWPGYTGEDC

SEQ ID NO: 1384 - protein, 31 aa, Homo sapiens
STRTCPRDCRGRGRCEDGECICDTGYSGDDC

SEQ ID NO: 1385 - protein, 31 aa, Homo sapiens
GVRSCPGDCNQRGRCEDGRCVCWPGYTGTDC

SEQ ID NO: 1386 - protein, 31 aa, Homo sapiens
GSRACPRDCRGRGRCENGVCVCNAGYSGEDC

SEQ ID NO: 1387 - protein, 32 aa, Homo sapiens
IMDDCSTNCNGNGECISGHCHCFPGFLGPDCA

SEQ ID NO: 1388 - protein, 32 aa, Homo sapiens
RDSCPVLCGGNGEYEKGHCVCRHGWKGPECDV

SEQ ID NO: 1389 - protein, 33 aa, Homo sapiens
PEEQCIDPTCFGHGTCIMGVCICVPGYKGEICE

SEQ ID NO: 1390 - protein, 33 aa, Homo sapiens
EEDCLDPMCSNHGICVKGECHCSTGWGGVNCET

SEQ ID NO: 1391 - protein, 34 aa, Homo sapiens
PLPVCQEQCSGHGTFLLDAGVCSCDPKWTGSDCS

SEQ ID NO: 1392 - protein, 30 aa, Homo sapiens
TELCTMECGSHGVCSRGICQCEEGWVGPTC

SEQ ID NO: 1393 - protein, 32 aa, Homo sapiens
EERSCHSHCTEHGQCKDGKCECSPGWEGDHCT

SEQ ID NO: 1394 - protein, 36 aa, Homo sapiens
VRDGCPGLCFGNGRCTLDQNGWHCVCQVGWSGTGCN

SEQ ID NO: 1395 - protein, 29 aa, Homo sapiens
DCPRNCHGNGECVSGVCHCFPGFLGADCA

SEQ ID NO: 1396 - protein, 37 aa, Homo sapiens
LGADCAKAACPVLCSGNGQYSKGTCQCYSGWKGAECD

SEQ ID NO: 1397 - protein, 33 aa, Homo sapiens
PMNQCIDPSCGGHGSCIDGNCVCSAGYKGEHCE

SEQ ID NO: 1398 - protein, 33 aa, Homo sapiens
EVDCLDPTCSSHGVCVNGECLCSPGWGGLNCEL

SEQ ID NO: 1399 - protein, 34 aa, Homo sapiens
ARVQCPDQCSGHGTYLPDTGLCSCDPNWMGPDCS

SEQ ID NO: 1400 - protein, 29 aa, Homo sapiens
VCSVDCGTHGVCIGGACRCEEGWTGAACD

SEQ ID NO: 1401 - protein, 29 aa, Homo sapiens
VCHPRCIEHGTCKDGKCECREGWNGEHCT

SEQ ID NO: 1402 - protein, 34 aa, Homo sapiens
DGCPDLCNGNGRCTLGQNSWQCVCQTGWRGPGCN

SEQ ID NO: 1403 - protein, 32 aa, Homo sapiens
SVVECPRNCHGNGECVSGTCHCFPGFLGPDCS

SEQ ID NO: 1404 - protein, 31 aa, Homo sapiens
RAACPVLCSGNGQYSKGRCLCFSGWKGTECD

SEQ ID NO: 1405 - protein, 33 aa, Homo sapiens
PTTQCIDPQCGGRGICIMGSCACNSGYKGESCE

SEQ ID NO: 1406 - protein, 32 aa, Homo sapiens
EADCIDPGCSNHGVCIHGECHCSPGWGGSNCE

SEQ ID NO: 1407 - protein, 34 aa, Homo sapiens
LKTMCPDQCSGHGTYLQESGSCTCDPNWTGPDCS

SEQ ID NO: 1408 - protein, 32 aa, Homo sapiens
NEICSVDCGSHGVCMGGTCRCEEGWTGPACNQ

SEQ ID NO: 1409 - protein, 30 aa, Homo sapiens
RACHPRCAEHGTCKDGKCECSQGWNGEHCT

SEQ ID NO: 1410 - protein, 35 aa, Homo sapiens
IEGCPGLCNSNGRCTLDQNGWHCVCQPGWRGAGCD

SEQ ID NO: 1411 - protein, 32 aa, Homo sapiens
SVDNCPSNCYGNGDCISGTCHCFLGFLGPDCG

SEQ ID NO: 1412 - protein, 31 aa, Homo sapiens
RASCPVLCSGNGQYMKGRCLCHSGWKGAECD

SEQ ID NO: 1413 - protein, 33 aa, Homo sapiens
PTNQCIDVACSNHGTCITGTCICNPGYKGESCE

SEQ ID NO: 1414 - protein, 32 aa, Homo sapiens
EVDCMDPTCSGRGVCVRGECHCSVGWGGTNCE

SEQ ID NO: 1415 - protein, 34 aa, Homo sapiens
PRATCLDQCSGHGTFLPDTGLCSCDPSWTGHDCS

SEQ ID NO: 1416 - protein, 32 aa, Homo sapiens
IEICAADCGGHGVCVGGTCRCEDGWMGAACDQ

SEQ ID NO: 1417 - protein, 30 aa, Homo sapiens
RACHPRCAEHGTCRDGKCECSPGWNGEHCT

SEQ ID NO: 1418 - protein, 44 aa, Homo sapiens
IAHYLDRVVKEGCPGLCNGNGRCTLDLNGWHCVCQLGWRGAGCD

SEQ ID NO: 1419 - protein, 30 aa, Homo sapiens
LNRTCCLNGGTCMLGSFCACPPSFYGRNCE

SEQ ID NO: 1420 - protein, 41 aa, Homo sapiens
GAWDCSVENGGCEHACNAIPGAPRCQCPAGAALQADGRSCT

SEQ ID NO: 1421 - protein, 41 aa, Homo sapiens
ATQSCNDLCEHFCVPNPDQPGSYSCMCETGYRLAADQHRCE

SEQ ID NO: 1422 - protein, 39 aa, Homo sapiens
DVDDCILEPSPCPQRCVNTQGGFECHCYPNYDLVDGECV

SEQ ID NO: 1423 - protein, 41 aa, Homo sapiens
PVDPCFRANCEYQCQPLNQTSYLCVCAEGFAPIPHEPHRCQ

SEQ ID NO: 1424 - protein, 37 aa, Homo sapiens
CQMFCNQTACPADCDPNTQASCECPEGYILDDGFICT

SEQ ID NO: 1425 - protein, 41 aa, Homo sapiens
DIDECENGGFCSGVCHNLPGTFECICGPDSALARHIGTDCD

SEQ ID NO: 1426 - protein, 41 aa, Homo sapiens
PIDGCLSNPCFAGVKCTSYPDGSWKCGACPPGYSGNGIQCT

SEQ ID NO: 1427 - protein, 45 aa, Homo sapiens
PRNPCTDGTHDCNKNAKCNYLGHYSDPMYRCECKPGYAGNGIICG

SEQ ID NO: 1428 - protein, 41 aa, Homo sapiens
PVDGCLSNPCFPGAQCSSFPDGSWSCGSCPVGFLGNGTHCE

SEQ ID NO: 1429 - protein, 45 aa, Homo sapiens
PENPCKDKTHNCHKHAECIYLGHFSDPMYKCECQTGYAGDGLICG

SEQ ID NO: 1430 - protein, 39 aa, Homo sapiens
DINECAHADPCFPGSSCINTMPGFHCEACPRGYKGTQVS

SEQ ID NO: 1431 - protein, 41 aa, Homo sapiens
DIDECNDGNNGGCDPNSICTNTVGSFKCGPCRLGFLGNQSQ

SEQ ID NO: 1432 - protein, 43 aa, Homo sapiens
PARTCHSPAHSPCHIHAHCLFERNGAVSCQCNVGWAGNGNVCG

SEQ ID NO: 1433 - protein, 40 aa, Homo sapiens
PPRRCDSNPCFRGVQCTDSRDGFQCGPCPEGYTGNGITCI

SEQ ID NO: 1434 - protein, 38 aa, Homo sapiens
DVDECKYHPCYPGVHCINLSPGFRCDACPVGFTGPMVQ

SEQ ID NO: 1435 - protein, 41 aa, Homo sapiens
DIDECRNGACVPNSICVNTLGSYRCGPCKPGYTGDQIRGCK

SEQ ID NO: 1436 - protein, 43 aa, Homo sapiens
AERNCRNPELNPCSVNAQCIEERQGDVTCVCGVGWAGDGYICG

SEQ ID NO: 1437 - protein, 44 aa, Homo sapiens
DVNECADGAHPPCHASARCRNTKGGFQCLCADPYELGDDGRTCV

SEQ ID NO: 1438 - protein, 39 aa, Homo sapiens
PVKSCSEPRCFNGGTCQQALYFSDFVCQCPEGFAGKCCE

SEQ ID NO: 1439 - protein, 42 aa, Homo sapiens
EEDECAKPDRGGCEQRCLNTLGSYQCACEPGYELGPDRRSCE

SEQ ID NO: 1440 - protein, 41 aa, Homo sapiens
DKDECSKDNGGCQHECVNTMGSYMCQCRNGFVLHDNKHDCK

SEQ ID NO: 1441 - protein, 42 aa, Homo sapiens
EVDECSWPDHGGCEHRCVNTLGSYKCACDPGYELAADKKMCE

SEQ ID NO: 1442 - protein, 41 aa, Homo sapiens
DKDECAKDNGGCQHECVNTFGSYLCRCRNGYWLHENGHDCK

SEQ ID NO: 1443 - protein, 41 aa, Homo sapiens
NHMPCPENLNGYCIHGKCEFIYSTQKASCRCESGYTGQHCE

SEQ ID NO: 1444 - protein, 41 aa, Homo sapiens
HHIPCPEHYNGFCMHGKCEHSINMQEPSCRCDAGYTGQHCE

SEQ ID NO: 1445 - protein, 37 aa, Homo sapiens
PCLNDCGPYGQCLLLRRHSYLYASCSCKAGWRGWSCT

SEQ ID NO: 1446 - protein, 40 aa, Homo sapiens
FLSPCVDDCGPYGQCKLLRTHNYLYAACECKAGWRGWGCT

SEQ ID NO: 1447 - protein, 43 aa, Homo sapiens
GCGAGRWGPGCTKECPGCLHGGVCHDHDGECVCPPGFTGTRCE

SEQ ID NO: 1448 - protein, 46 aa, Homo sapiens
ACREGRFGQSCQEQCPGISGCRGLTFCLPDPYGCSCGSGWRGSQCQ

SEQ ID NO: 1449 - protein, 41 aa, Homo sapiens
ACAPGHFGADCRLQCQCQNGGTCDRFSGCVCPSGWHGVHCE

SEQ ID NO: 1450 - protein, 37 aa, Homo sapiens
VPSNCDCLNGGTCVSNKYFSNIHWCNCPKKFGGQHCE

SEQ ID NO: 1451 - protein, 37 aa, Homo sapiens
EARWCSECHSNATCTEDEAVTTCTCQEGFTGDGLTCV

SEQ ID NO: 1452 - protein, 43 aa, Homo sapiens
DLDECAIPGAHNCSANSSCVNTPGSFSCVCPEGFRLSPGLGCT

SEQ ID NO: 1453 - protein, 42 aa, Homo sapiens
DVDECAEPGLSHCHALATCVNVVGSYLCVCPAGYRGDGWHCE

SEQ ID NO: 1454 - protein, 50 aa, Homo sapiens
DVNECFYEELNACSGRELCANLEGSYWCVCHQEAPATSPRKLNLEWEDCP

SEQ ID NO: 1455 - protein, 46 aa, Homo sapiens
DWDECVDSAEHDCSPAAWCINLEGSYTCQCRTTRDATPSRAGRACE

SEQ ID NO: 1456 - protein, 42 aa, Homo sapiens
DYDECERKEDDCVPGTSCRNTLGSFTCSCEGGAPDFPVEYSE

SEQ ID NO: 1457 - protein, 57 aa, Homo sapiens
CQCHGHADNCDTTSQPYRCLCSQESFTEGLHCDRCLPLYNDKPFRQGDQVYAFNCKP

SEQ ID NO: 1458 - protein, 51 aa, Homo sapiens
CNCHLSGALNETCHLVTGQCFCKQFVTGSKCDACVPSASHLDVNNLLGCSK

SEQ ID NO: 1459 - protein, 66 aa, Homo sapiens
CQCNSHSKSCHYNISVDPFPFEHFRGGGGVCDDCEHNTTGRNCELCKDYFFRQVGADPSAIDVCKP

SEQ ID NO: 1460 - protein, 53 aa, Homo sapiens
CDCDTVGTRNGSILCDQIGGQCNCKRHVSGRQCNQCQNGFYNLQELDPDGCSP

SEQ ID NO: 1461 - protein, 53 aa, Homo sapiens
CNCNTSGTVDGDITCHQNSGQCKCKANVIGLRCDHCNFGFKFLRSFNDVGCEP

SEQ ID NO: 1462 - protein, 48 aa, Homo sapiens
CQCNLHGSVNKFCNPHSGQCECKKEAKGLQCDTCRENFYGLDVTNCKA

SEQ ID NO: 1463 - protein, 52 aa, Homo sapiens
CDCDTAGSLPGTVCNAKTGQCICKPNVEGRQCNKCLEGNFYLRQNNSFLCLP

SEQ ID NO: 1464 - protein, 53 aa, Homo sapiens
CNCDKTGTINGSLLCNKSTGQCPCKLGVTGLRCNQCEPHRYNLTIDNFQHCQM

SEQ ID NO: 1465 - protein, 51 aa, Homo sapiens
CECDSLGTLPGTICDPISGQCLCVPNRQGRRCNQCQPGFYISPGNATGCLP

SEQ ID NO: 1466 - protein, 51 aa, Homo sapiens
CSCHTTGAVNHICNSLTGQCVCQDASIAGQRCDQCKDHYFGFDPQTGRCQP

SEQ ID NO: 1467 - protein, 38 aa, Homo sapiens
QPQDCPPSTCLNGGTCHLGTRHHLACLCPEGFTGLYCE

SEQ ID NO: 1468 - protein, 37 aa, Homo sapiens
GPDRCKMNPCLNGGTCYPTETSYVCTCVPGYSGDQCE

SEQ ID NO: 1469 - protein, 40 aa, Homo sapiens
HINECLVNNGGCSHICKDLVIGYECDCAAGFELIDRKTCG

SEQ ID NO: 1470 - protein, 40 aa, Homo sapiens
DIDECQNPGICSQICINLKGGYKCECSRGYQMDLATGVCK

SEQ ID NO: 1471 - protein, 49 aa, Homo sapiens
GKNWCEEDMENGGCEYLCLPAPQINDHSPKYTCSCPSGYNVEENGRDCQ

SEQ ID NO: 1472 - protein, 36 aa, Homo sapiens
LEHPCASLCCGHGTCIDGIGSFSCDCRSGWEGRFCQ

SEQ ID NO: 1473 - protein, 41 aa, Homo sapiens
SFLNCSLDNGGCTHYCLEEVGWRRCSCAPGYKLGDDLLQCH

SEQ ID NO: 1474 - protein, 39 aa, Homo sapiens
IPDQCSPLPCNEDGYMSCKDGKASFTCTCKPGWQGEKCE

SEQ ID NO: 1475 - protein, 44 aa, Homo sapiens
DINECKDPSNINGGCSQICDNTPGSYHCSCKNGFVMLSNKKDCK

SEQ ID NO: 1476 - protein, 42 aa, Homo sapiens
DVDECSLKPSICGTAVCKNIPGDFECECPEGYRYNLKSKSCE

SEQ ID NO: 1477 - protein, 41 aa, Homo sapiens
DIDECSENMCAQLCVNYPGGYTCYCDGKKGFKLAQDQKSCE

SEQ ID NO: 1478 - protein, 37 aa, Homo sapiens
GGSPCISQPCLHNGSCQDSIWGYTCTCSPGYEGSNCE

SEQ ID NO: 1479 - protein, 42 aa, Homo sapiens
AKNECHPERTDGCQHFCLPGQESYTCSCAQGYRLGEDHKQCV

SEQ ID NO: 1480 - protein, 38 aa, Homo sapiens
PGPCDSQPCQNGGTCVPEGLDGYQCLCPLAFGGEANCA

SEQ ID NO: 1481 - protein, 37 aa, Homo sapiens
PVNLCKPSPCMNEGSCVLQNGSYRCKCRDGWEGPHCE

SEQ ID NO: 1482 - protein, 29 aa, Homo sapiens
LCSFGCGSGICIAPNVCSCQDGEQGATCP

SEQ ID NO: 1483 - protein, 39 aa, Homo sapiens
DIDECVTSSCEGHCVNTEGGFVCECGPGMQLSADRHSCQ

SEQ ID NO: 1484 - protein, 39 aa, Homo sapiens
DTDECLGTPCQQRCKNSIGSYKCSCRTGFHLHGNRHSCV

SEQ ID NO: 1485 - protein, 43 aa, Homo sapiens
DVNECRRPLERRVCHHSCHNTVGSFLCTCRPGFRLRADRVSCE

SEQ ID NO: 1486 - protein, 40 aa, Homo sapiens
TVKSCDCLNGGSCVSDRNFSPGSGVYLCVCLPGFHGSLCE

SEQ ID NO: 1487 - protein, 33 aa, Homo sapiens
AFTICKYPCGKSRECVAPNICKCKPGYIGSNCQ

SEQ ID NO: 1488 - protein, 33 aa, Homo sapiens
DEEHCNPPCQHGGTCLAGNLCTCPYGFVGPRCE

SEQ ID NO: 1489 - protein, 33 aa, Homo sapiens
STALCDPVCLNGGSCNKPNTCLCPNGFFGEHCQ

SEQ ID NO: 1490 - protein, 32 aa, Homo sapiens
NAFCHPPCKNGGHCMRNNVCVCREGYTGRRFQ

SEQ ID NO: 1491 - protein, 33 aa, Homo sapiens
NTPICLQKCKNGGECIAPSICHCPSSWEGVRCQ

SEQ ID NO: 1492 - protein, 32 aa, Homo sapiens
IPICNPKCLYGGRCIFPNVCSCRTEYSGVKCE

SEQ ID NO: 1493 - protein, 33 aa, Homo sapiens
QQAECPGGCRNGGFCNERRICECPDGFHGPHCE

SEQ ID NO: 1494 - protein, 32 aa, Homo sapiens
KALCTPRCMNGGLCVTPGFCICPPGFYGVNCD

SEQ ID NO: 1495 - protein, 29 aa, Homo sapiens
KANCSTTCFNGGTCFYPGKCICPPGLEGE

SEQ ID NO: 1496 - protein, 33 aa, Homo sapiens
EISKCPQPCRNGGKCIGKSKCKCSKGYQGDLCS

SEQ ID NO: 1497 - protein, 32 aa, Homo sapiens
KPVCEPGCGAHGTCHEPNKCQCQEGWHGRHCN

SEQ ID NO: 1498 - protein, 37 aa, Homo sapiens
PESPCLQNPCQNDGQCREQGATFTCECEVGYGGGLCM

SEQ ID NO: 1499 - DNA, 31 bp, Artificial Sequence
  primer 1 for amplification of the gene for the fusion protein RFP-hF VII-EGF1 with a red fluorescent protein (RFP) tag
taacatatggtgagcaagggcgaggaggata

SEQ ID NO: 1500 - DNA, 50 bp, Artificial Sequence
  primer 2 for amplification of the gene for the fusion protein RFP-hF VII-EGF1 with a red fluorescent protein (RFP) tag
gaaaacctgtacttccagggtcaattcgaagatggggaccagtgtgcctc

SEQ ID NO: 1501 - DNA, 34 bp, Artificial Sequence
  primer 3 for amplification of the gene for the fusion protein RFP-hF VII-EGF1 with a red fluorescent protein (RFP) tag
cctggaagtacaggttttccttgtacagctcgtc

SEQ ID NO: 1502 - DNA, 33 bp, Artificial Sequence
  primer 4 for amplification of the gene for the fusion protein RFP-hF VII-EGF1 with a red fluorescent protein (RFP) tag
tatggatccttactcacagttccggccctcgaa

SEQ ID NO: 1503 - DNA, 39 bp, Artificial Sequence
  primer 1 for the construction of the recombinant eukaryotic plasmid for expressing the fusion protein RFP-hF VII-EGF1
taaggatcctgcagagatttcatcatgcatcatcatcat

SEQ ID NO: 1504 - DNA, 25 bp, Artificial Sequence
  primer 2 for the construction of the recombinant eukaryotic plasmid for expressing the fusion protein RFP-hF VII-EGF1
tatctcgagttactcacagttccgg

The invention claimed is:

1. A method for treating a Gram-negative bacterial infection, said method comprises administering an effective amount of human-originated EGF domain protein or a composition thereof to a subject in need thereof.

2. The method of claim 1, wherein the Gram-negative bacterial infection causes endotoxemia.

3. The method of claim 1, wherein the human-originated EGF domain protein comprises the amino acid sequence of any one of SEQ ID NO:1-SEQ ID NO:1498 or any combination thereof.

4. The method of claim 2, wherein the human-originated EGF domain protein comprises the amino acid sequence of any one of SEQ ID NO:1-SEQ ID NO:1498 or any combination thereof.

5. The method of claim 3, wherein the human-originated EGF domain protein is a human coagulation factor EGF domain protein comprising the amino acid sequence of any one of SEQ ID NO:1, SEQ ID NO:2, SEQ ID NO:3, SEQ ID NO:4, SEQ ID NO:5, SEQ ID NO:6, SEQ ID NO:108, SEQ ID NO:109, SEQ ID NO:1472, SEQ ID NO:1473, SEQ ID NO:1474, SEQ ID NO:1475, SEQ ID NO:1476, SEQ ID NO:1477, SEQ ID NO:1478 or SEQ ID NO:1479.

6. The method of claim 4, wherein the human-originated EGF domain protein is a human coagulation factor EGF domain protein comprises the amino acid sequence of any one of SEQ ID NO:1, SEQ ID NO:2, SEQ ID NO:3, SEQ ID NO:4, SEQ ID NO:5, SEQ ID NO:6, SEQ ID NO:108, SEQ ID NO:109, SEQ ID NO:1472, SEQ ID NO:1473, SEQ ID NO:1474, SEQ ID NO:1475, SEQ ID NO:1476, SEQ ID NO:1477, SEQ ID NO:1478 or SEQ ID NO:1479.

7. The method of claim 1, wherein the Gram-negative bacteria is one or more of *Escherichia coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris* and *Serratia marcescens*.

8. The method of claim 2, wherein the Gram-negative bacteria is one or more of *Escherichia coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris* and *Serratia marcescens*.

9. The method of claim 3, wherein the Gram-negative bacteria is one or more of *Escherichia coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris* and *Serratia marcescens*.

10. The method of claim 4, wherein the Gram-negative bacteria is one or more of *Escherichia coli, Pseudomonas* aeruginosa, Klebsiella pneumonia, Enterobacter cloacae, Aeromonas hydrophila, Citrobacter diversus, Moraxella catarrhalis, Proteus mirabilis, Proteus vulgaris and Serratia marcescens.

11. The method of claim 5, wherein the Gram-negative bacteria is one or more of *Escherichia coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris* and *Serratia marcescens*.

12. The method of claim 6, wherein the Gram-negative bacteria is one or more of *Escherichia coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris* and *Serratia marcescens*.

13. A method for hydrolyzing a lipopolysaccharide of Gram-negative bacteria, said method comprising contacting the lipopolysaccharide with an effective amount of human-originated EGF domain protein or a composition containing human-originated EGF domain protein to hydrolyze the lipopolysaccharide.

14. The method of claim 13, wherein the Gram-negative bacteria is one or more of *Escherichia coli, Pseudomonas aeruginosa, Klebsiella pneumonia, Enterobacter cloacae, Aeromonas hydrophila, Citrobacter diversus, Moraxella catarrhalis, Proteus mirabilis, Proteus vulgaris* and *Serratia marcescens*.

15. The method of claim 13, wherein the human-originated EGF domain protein comprises the amino acid sequence of any one of SEQ ID NO:1-SEQ ID NO:1498 or any combination thereof.

16. The method of claim 14, wherein the human-originated EGF domain protein comprises the amino acid sequence of any one of SEQ ID NO:1-SEQ ID NO:1498 or any combination thereof.

17. The method of claim 13, wherein the human-originated EGF domain protein is a human coagulation factor EGF domain protein comprising the amino acid sequence of any one of SEQ ID NO:1, SEQ ID NO:2, SEQ ID NO:3, SEQ ID NO:4, SEQ ID NO:5, SEQ ID NO:6, SEQ ID NO:108, SEQ ID NO:109, SEQ ID NO:1472, SEQ ID NO:1473, SEQ ID NO:1474, SEQ ID NO:1475, SEQ ID NO:1476, SEQ ID NO:1477, SEQ ID NO:1478 or SEQ ID NO:1479.

18. The method of claim 15, wherein the human-originated EGF domain protein is a human coagulation factor EGF domain protein comprising the amino acid sequence of any one of SEQ ID NO:1, SEQ ID NO:2, SEQ ID NO:3, SEQ ID NO:4, SEQ ID NO:5, SEQ ID NO:6, SEQ ID NO:108, SEQ ID NO:109, SEQ ID NO:1472, SEQ ID NO:1473, SEQ ID NO:1474, SEQ ID NO:1475, SEQ ID NO:1476, SEQ ID NO:1477, SEQ ID NO:1478 or SEQ ID NO:1479.

\* \* \* \* \*